US010385319B2

(12) United States Patent
Puckette et al.

(10) Patent No.: US 10,385,319 B2
(45) Date of Patent: Aug. 20, 2019

(54) MODIFIED FOOT-AND-MOUTH DISEASE VIRUS 3C PROTEASES, COMPOSITIONS AND METHODS THEREOF

(71) Applicant: The United States of America, as represented by the Secretary of Homeland Security, Washington, DC (US)

(72) Inventors: Michael Puckette, Waterford, CT (US); Max V. Rasmussen, Guilford, CT (US)

(73) Assignee: The Governement of the United States of America, as represented by the Secretary of Homeland Security, Washington, DC (US)

( * ) Notice: Subject to any disclaimer, the term of this patent is extended or adjusted under 35 U.S.C. 154(b) by 0 days.

(21) Appl. No.: 15/259,409

(22) Filed: Sep. 8, 2016

(65) Prior Publication Data

US 2018/0066235 A1 Mar. 8, 2018

(51) Int. Cl.
| | |
|---|---|
| *C12N 7/00* | (2006.01) |
| *A61K 39/135* | (2006.01) |
| *C07K 14/005* | (2006.01) |
| *C12N 9/50* | (2006.01) |
| *G01N 33/569* | (2006.01) |
| *G01N 33/68* | (2006.01) |
| *A61K 39/12* | (2006.01) |
| *C07K 16/10* | (2006.01) |
| *G01N 33/573* | (2006.01) |
| *A61P 31/14* | (2006.01) |

(52) U.S. Cl.
CPC ............... *C12N 7/00* (2013.01); *A61K 39/12* (2013.01); *A61K 39/135* (2013.01); *A61P 31/14* (2018.01); *C07K 14/005* (2013.01); *C07K 16/1009* (2013.01); *C12N 9/506* (2013.01); *C12Y 304/22028* (2013.01); *G01N 33/56972* (2013.01); *G01N 33/56983* (2013.01); *G01N 33/573* (2013.01); *G01N 33/6854* (2013.01); *C12N 2770/32122* (2013.01); *C12N 2770/32123* (2013.01); *C12N 2770/32134* (2013.01); *C12N 2770/32151* (2013.01); *G01N 2333/09* (2013.01); *G01N 2333/9513* (2013.01)

(58) Field of Classification Search
None
See application file for complete search history.

(56) References Cited

U.S. PATENT DOCUMENTS

| 6,232,107 B1 | 5/2001 | Bryan et al. |
|---|---|---|
| 8,236,548 B2 | 8/2012 | Chen |
| 2011/0143362 A1 | 6/2011 | Oyler et al. |
| 2011/0236416 A1 | 9/2011 | Audonnet et al. |
| 2012/0122182 A1 | 5/2012 | Tannous et al. |
| 2012/0258133 A1 | 10/2012 | Charleston |
| 2012/0315295 A1 | 12/2012 | Rieder et al. |
| 2013/0243809 A1 | 9/2013 | Liao et al. |
| 2014/0186959 A1 | 7/2014 | Slater et al. |
| 2018/0066235 A1* | 3/2018 | Puckette ............. A61K 39/135 |
| 2018/0066267 A1 | 3/2018 | Puckette et al. |

OTHER PUBLICATIONS

Yang et al. (PeerJ. 2016; DOI 10.7717/peerj.1964).*
Veerapen et al. (Virus Research. 2018; 244: 213-217).*
Zunszain et al. (Journal of Molecular Biology. 2010; 395: 375-389).*
Sweeney et al. (Journal of Virology. Jan. 2007; 8 (1): 115-124).*
Shao L, Feng W, Sun Y, Bai H, Liu J, Currie C, et al. Generation of iPS cells using defined factors linked via the self-cleaving 2A sequences in a single open reading frame. Cell research. 2009;19:296-306.
Mir FA, Kaufmann SH, Eddine AN. A multicistronic DNA vaccine induces significant protection against tuberculosis in mice and offers flexibility in the expressed antigen repertoire. Clinical and vaccine immunology : CVI. 2009;16:1467-75.
Rothwell DG, Crossley R, Bridgeman JS, Sheard V, Zhang Y, Sharp TV, et al. Functional expression of secreted proteins from a bicistronic retroviral cassette based on foot-and-mouth disease virus 2A can be position dependent. Human gene therapy. 2010;21:1631-7.
Breese SS, Jr., Graves JH. Electron microscopic observation of crystalline arrays of foot-and-mouth disease virus. Journal of bacteriology. 1966;92:1835-7.
Breese SS. Reactions of intracellular crystals of foot-and-mouth disease virus with ferritin-tagged antibody. J Gen Virol. 1969;4:343-6.
Kay MA, He CY, Chen ZY. A robust system for production of minicircle DNA vectors, Nature Biotechnology. 2010;28:1287-89.
Birtley JR, Curry S. Crystallization of foot-and-mouth disease virus 3C protease: surface mutagenesis and a novel crystal-optimization strategy. Acta Crystallographica Section D Biological Crystallography. 2005;61:646-650.
Birtley JR, Knox SR, Jaulent AM, Brick, P, Leatherbarrow RJ, et al. Crystal structure of foot-and-mouth disease virus 3C protease. 2005;280:11520-527.

(Continued)

Primary Examiner — Shanon A. Foley
(74) Attorney, Agent, or Firm — Lavanya Ratnam; Kelly G. Hyndman; Joseph Hsiao

(57) ABSTRACT

This application is directed generally to foot-and-mouth disease virus (FMDV) 3C proteases that have been modified by mutating a polynucleotide sequence coding for the FMDV 3C protease. The modified FMDV proteases exhibit proteolytic activity on FMDV P1 precursor protein and exhibit a reduction in one or more toxic or inhibitory properties associated with an unmodified FMDV 3C protease on a host cell used to recombinantly produce it. Vectors carrying polynucleotides encoding modified FMDV 3C protease sequences can induce production of FMDV virus-like particles in a host cell when expressed in the host cell. The modified FMDV 3C proteases can generally be used to produce immunogenic FMDV preparations capable of inducing an immune response against FMDV.

100 Claims, 38 Drawing Sheets

Specification includes a Sequence Listing.

(56) References Cited

OTHER PUBLICATIONS

Sweeney, TR, Roqué-Rosell N, Birtley JR, Leatherbarrow RJ, Curry S. Structural and mutagenic analysis of foot-and-mouth disease virus 3C protease reveals the role of the □-ribbon in proteolysis. J Virol. Jan. 2007;81(1):115-24. Epub Oct. 25, 2006.

Vakharia VN, Devaney MA, Moore DM, Dunn JJ, Grubman MJ. Proteolytic processing of foot-and-mouth disease virus polyproteins expressed in a cell-free system from clone-derived transcripts. Journal of virology. 1987;61:3199-207.

Mayr GA, Chinsangaram J, Grubman MJ. Development of replication-defective adenovirus serotype 5 containing the capsid and 3C protease coding regions of foot-and-mouth disease virus as a vaccine candidate. Virology. 1999;263:496-506.
Mayr GA, O'Donnell V, Chinsangaram J, Mason PW, Grubman MJ. Immune responses and protection against foot-and-mouth disease virus (FMDV) challenge in swine vaccinated with adenovirus-FMDV constructs. Vaccine. 2001;19:2152-62.
Moraes MP, Mayr GA, Mason PW, Grubman MJ. Early protection against homologous challenge after a single dose of replication-defective human adenovirus type 5 expressing capsid proteins of foot-and-mouth disease virus (FMDV) strain A24. Vaccine. 2002;20:1631-9.
Gullberg M, Muszynski B, Organtini LJ, Ashley RE, Hafenstein SL, Belsham GJ, et al. Assembly and characterization of foot-and-mouth disease virus empty capsid particles expressed within mammalian cells. The Journal of general virology. 2013;94:1769-79.
Porta C, Xu X, Loureiro S, Paramasivam S, Ren J, Al-Khalil T, et al. Efficient production of foot-and-mouth disease virus empty capsids in insect cells following down regulation of 3C protease activity. Journal of virological methods. 2013;187:406-12.
Porta C, Kotecha A, Burman A, Jackson T, Ren J, Loureiro S, et al. Rational engineering of recombinant Picornavirus capsids to produce safe, protective vaccine antigen. PLOS Pathogens. 2013;9:e1003255.
Dus Santos MJ, Carrillo C, Ardila F, Rios RD, Franzone P, Piccone ME, et al. Development of transgenic alfalfa plants containing the foot and mouth disease virus structural polyprotein gene P1 and its utilization as an experimental immunogen. Vaccine. 2005;23:1838-43.
Grubman MJ, Zellner M, Bablanian G, Mason PW, Piccone ME. Identification of the active-site residues of the 3C proteinase of foot-and-mouth disease virus. Virology. 1995;213:581-9.
Falk MM, Grigera PR, Bergmann IE, Zibert A, Multhaup G, Beck E. Foot-and-mouth disease virus protease 3C induces specific proteolytic cleavage of host cell histone H3. Journal of virology. 1990;64:748-56.
Belsham GJ, McInerney GM, Ross-Smith N. Foot-and-mouth disease virus 3C protease induces cleavage of translation initiation factors elF4A and elF4G within infected cells. Journal of virology. 2000;74:272-80.
Li W, Ross-Smith N, Proud CG, Belsham GJ. Cleavage of translation initiation factor 4Al(e1F4Al) but not elF4All by foot-and-mouth disease virus 3C protease: identification of the elF4Al cleavage site. FEBS letters. 2001;507:1-5.
Lawrence P, Schafer EA, Rieder E. The nuclear protein Sam68 is cleaved by the FMDV 3C protease redistributing Sam68 to the cytoplasm during FMDV infection of host cells. Virology. 2012;425:40-52.
Wang D, Fang L, Li K, Zhong H, Fan J, Ouyang C, et al. Foot-and-mouth disease virus 3C protease cleaves NEMO to impair innate immune signaling. Journal of virology. 2012;86:9311-22.
Zhou Z, Mogensen MM, Powell PP, Curry S, Wileman T. Foot-and-mouth disease virus 3C protease induces fragmentation of the Golgi compartment and blocks intra-Golgi transport. Journal of virology. 2013;87:11721-9.
Zunszain PA, Knox SR, Sweeney TR, Yang J, Roque-Rosell N, Belsham GJ, et al. Insights into cleavage specificity from the crystal structure of foot-and-mouth disease virus 3C protease complexed with a peptide substrate. Journal of molecular biology. 2010;395:375-89.
Tannous BA, Kim DE, Fernandez JL, Weissleder R, Breakefield XO. Codon-optimized Gaussia luciferase cDNA for mammalian gene expression in culture and in vivo. Mol Ther. 2005;11:435-43.
Verhaegent M, Christopoulos TK. Recombinant Gaussia luciferase. Overexpression, purification, and analytical application of a bioluminescent reporter for DNA hybridization. Anal Chem. 2002;74:4378-85.
Chung E, Yamashita H, Au P, Tannous BA, Fukumura D, Jain RK. Secreted Gaussia luciferase as a biomarker for monitoring tumor progression and treatment response of systemic metastases. PLoS One. 2009;4:e8316.
Tannous BA. Gaussia luciferase reporter assay for monitoring biological processes in culture and in vivo. Nat Protoc. 2009;4:582-91.
Wurdinger T, Badr C, Pike L, de Kleine R, Weissleder R, Breakefield XO, et al. A secreted luciferase for ex vivo monitoring of in vivo processes. Nat Methods. 2008;5:171-3.
Inoue Y, Sheng F, Kiryu S, Watanabe M, Ratanakanit H, Izawa K, et al. Gaussia luciferase for bioluminescence tumor monitoring in comparison with firefly luciferase. Mol Imaging. 2011;10:377-85.
El-Amouri SS, Cao P, Miao C, Pan D. Secreted luciferase for in vivo evaluation of systemic protein delivery in mice. Mol Biotechnol. 2012;53:63-73.
Griesenbach U, Vicente CC, Roberts MJ, Meng C, Soussi S, Xenariou S, et al. Secreted Gaussia luciferase as a sensitive reporter gene for in vivo and ex vivo studies of airway gene transfer. Biomaterials. 2011;32:2614-24.
Kim SB, Suzuki 1-1, Sato M, Tao H. Superluminescent variants of marine luciferases for bioassays. Anal Chem. 2011;83:8732-40.
de Felipe P. Polycistronic viral vectors. Current gene therapy. 2002;2:355-78.
Ryan MD, Drew J. Foot-and-mouth disease virus 2A oligopeptide mediated cleavage of an artificial polyprotein. The EMBO journal. 1994;13:928-33.
Donnelly ML, Luke G, Mehrotra A, Li X, Hughes LE, Gani D, et al. Analysis of the aphthovirus 2A/2B polyprotein cleavage' mechanism indicates not a proteolytic reaction, but a novel translational effect: a putative ribosomal 'skip'. The Journal of general virology. 2001;82:1013-25.
Minskaia E, Ryan MD. Protein coexpression using FMDV 2A: effect of "linker" residues. BioMed research international. 2013;2013:291730.
Donnelly ML, Gani D, Flint M, Monaghan S, Ryan MD. The cleavage activities of aphthovirus and cardiovirus 2A proteins. J Gen Virol. 1997;78 ( Pt 1):13-21.
Luke GA, de Felipe P, Lukashev A, Kallioinen SE, Bruno EA, Ryan MD. Occurrence, function and evolutionary origins of '2A-like' sequences in virus genomes. J Gen Virol. 2008;89:1036-42.
Kim JH, Lee SR, Li LH, Park HJ, Park JH, Lee KY, et al. High cleavage efficiency of a 2A peptide derived from porcine teschovirus-1 in human cell lines, zebrafish and mice. PLoS One. 2011;6:e18556.
Torres V, Barra L, Garces F, Ordenes K, Leal-Ortiz S, Garner CC, et al. A bicistronic lentiviral vector based on the 1D/2A sequence of foot-and-mouth disease virus expresses proteins stoichiometrically. Journal of biotechnology. 2010;146:138-42.
Ahier A, Jarriault S. Simultaneous expression of multiple proteins under a single promoter in Caenorhabditis elegans via a versatile 2A-based toolkit. Genetics. 2014;196:605-13.
Daniels RW, Rossano AJ, Macleod GT, Ganetzky B. Expression of multiple transgenes from a single construct using viral 2A peptides in Drosophila. PLoS One. 2014;9:e100637.
Unkles SE, Valiante V, Mattem DJ, Brakhage AA. Synthetic biology tools for bioprospecting of natural products in eukaryotes. Chemistry & biology. 2014;21:502-8.
Heinonen AM, Rahman M, Dogbevia G, Jakobi H, Wolfl S, Sprengel R, et al. Neuroprotection by rAAV-mediated gene transfer of bone morphogenic protein 7. BMC neuroscience. 2014;15:38.
Jung L, Tropel P, Moal Y, Teletin M, Jeandidier E, Gayon R, et al. ONSL and OSKM cocktails act synergistically in reprogramming

(56) References Cited

OTHER PUBLICATIONS human somatic cells into induced pluripotent stem cells. Molecular human reproduction. 2014;20:538-49.

Beekwilder J, van Rossum HM, Koopman F, Sonntag F, Buchhaupt M, Schrader J, et al. Polycistronic expression of a beta-carotene biosynthetic pathway in *Saccharomyces cerevisiae* coupled to beta-ionone production. Journal of biotechnology. 2014.

de Felipe P, Martin V, Cortes ML, Ryan M, Izquierdo M. Use of the 2A sequence from foot-and-mouth disease virus in the generation of retroviral vectors for gene therapy. Gene Ther. 1999;6:198-208.

Geu-Flores F, Olsen CE, Halkier BA. Towards engineering glucosinolates into non-cruciferous plants. Planta. 2009;229:261-70.

Carey BW, Markoulaki S, Hanna J, Saha K, Gao Q, Mitalipova M, et al. Reprogramming of murine and human somatic cells using a single polycistronic vector. Proceedings of the National Academy of Sciences of the United States of America. 2009;106:157-62.

G. R. Stark, I. M. Kerr, B. R. Williams, R. H. Silverman, R. D. Schreiber, How cells respond to interferons. Annual review of biochemistry 67, 227-264 (1998).

K. Schroder, P. J. Hertzog, T. Ravasi, D. A. Hume, Interferon-gamma: an overview of signals, mechanisms and functions. Journal of leukocyte biology 75, 163-189 (2004).

H. M. Lazear, T. J. Nice, M. S. Diamond, Interferon-lambda: Immune Functions at Barrier Surfaces and Beyond. Immunity 43, 15-28 (2015).

J. Chinsangaram, M. Koster, M. J. Grubman, Inhibition of L-deleted foot-and-mouth disease virus replication by alpha/beta interferon involves double-stranded RNA-dependent protein kinase. Journal of virology 75, 5498-5503 (2001).

J. Chinsangaram, M. P. Moraes, M. Koster, M. J. Grubman, Novel viral disease control strategy: adenovirus expressing alpha interferon rapidly protects swine from foot-and-mouth disease. Journal of virology 77, 1621-1625 (2003).

H. Yin et al., Antitumor potential of a synthetic interferon-alpha/ PLGF-2 positive charge peptide hybrid molecule in pancreatic cancer cells. Scientific reports 5, 16975 (2015).

M. Nakamura et al., Expression and visualization of a human interferon-beta-enhanced green fluorescent protein chimeric molecule in cultured cells. Biological & pharmaceutical bulletin 27, 411-414 (2004).

M. Maruyama et al., Simultaneous detection of DsRed2-tagged and EGFP-tagged human beta-interferons in the same single cells. Journal of cellular biochemistry 93, 497-502 (2004).

M. M. Mizokami, P. Hu, L. A. Khawli, J. Li, A. L. Epstein, Chimeric TNT-3 antibody/murine interferon-gamma fusion protein for the immunotherapy of solid malignancies. Hybridoma and hybridomics 22, 197-207 (2003).

M. Verhaegen, T. K. Christopoulos, Recombinant Gaussia luciferase. Overexpression, purification, and analytical application of a bioluminescent reporter for DNA hybridization. Analytical chemistry 74, 4378-4385 (2002).

B. A. Tannous, D. E. Kim, J. L. Fernandez, R. Weissleder, X. O. Breakefield, Codon-optimized Gaussia luciferase cDNA for mammalian gene expression in culture and in vivo. Molecular therapy : the journal of the American Society of Gene Therapy 11, 435-443 (2005).

S. B. Kim, H. Suzuki, M. Sato, H. Tao, Superluminescent variants of marine luciferases for bioassays. Analytical chemistry 83, 8732-8740 (2011).

Díaz-San Segundo F, et al. Antiviral activity of bovine type III interferon against foot-and-mouth disease virus. Virology. May 10, 2011;413(2):283-92.

Perez-Martin E, et al. Bovine type III interferon significantly delays and reduces the severity of foot-and-mouth disease in cattle. J Virol. Apr. 2012;86(8):4477-87.

Wu et al. (Biochemica et Biophysica Acta. 2015; 1854: 1392-1399). Alignment of SEQ ID 24 with Genseq access No. ABB81097 Jun. 2007 Zuckermann in WO20260921.

Cheng et al. (Gene. 2006; 382: 28-38).

Alignment of SEQ ID 4 with Genseq db access AYL 17606 Dec. 2010 Sungbae et al. in WO2010119721.

Luker et al. (Nature Medicine, Jan. 2012; 18 (1): 172-177.

International Search Report and the Written Opinion of the International Searching Authority for PCT/US2017/048828 dated Jan. 29, 2018.

* cited by examiner

```
         αN                  A₁              B₁            C₁                D₁    E₁
          10          20          30          40          50          60
SGAPPTDLQK MVMSNIKPVE LILDGKTVAI CCATGVFGTA YLVPRHLFAE KYDRIMLDGR
     E₁         E₁              F₁                                      A₂
          70          80          90         100         110         120
AMTDSDYRVF EFEIKVKGQD MLSDAALMVL HRGNRVRDIT KHFRDTARMK KGTPVVGVIN
       B₂                       β-ribbon              C₂          D₂             E₂
         130         140         150         160         170         180
NADVGRLIES GEALTY DIV VCMDGDIMPG LEAYRAATKA GYCGGAVLAK DGADTEIVGT
    E₂              F₂              αC
         190         200         210
HSAGGNGVGY CSCVSRSMIL KMKAHIDPEP HHE
```

*FIG. 3*

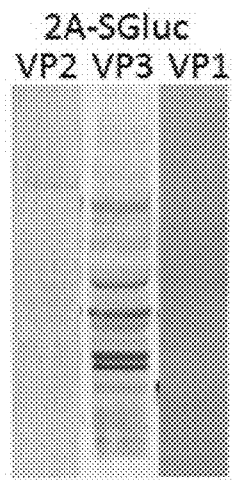
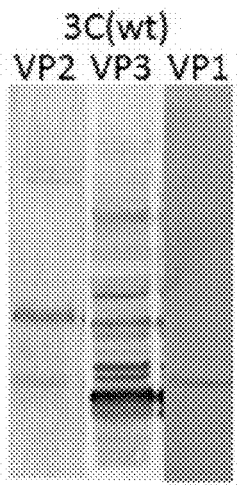
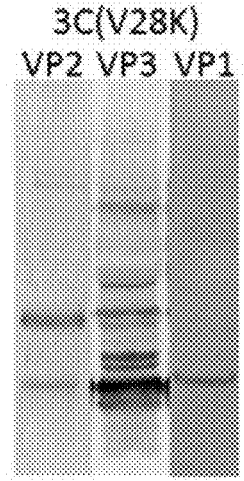
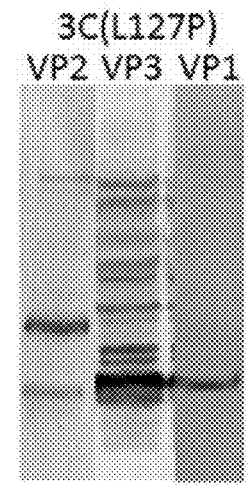
FIG. 9A  FIG. 9B  FIG. 9C  FIG. 9D
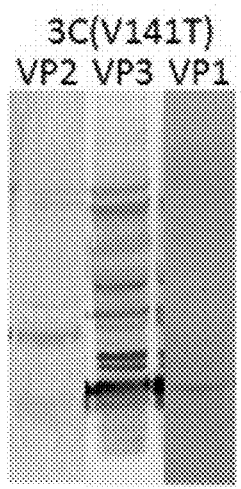
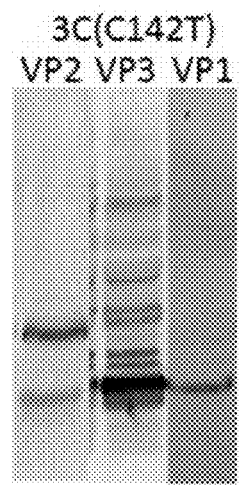
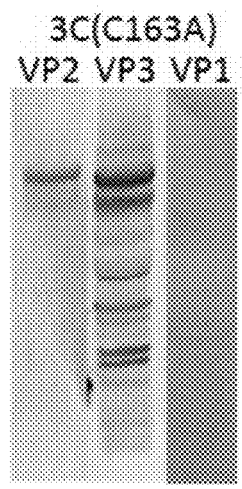
FIG. 9E  FIG. 9F  FIG. 9G

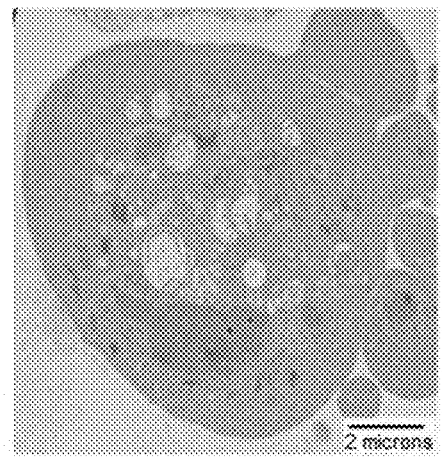 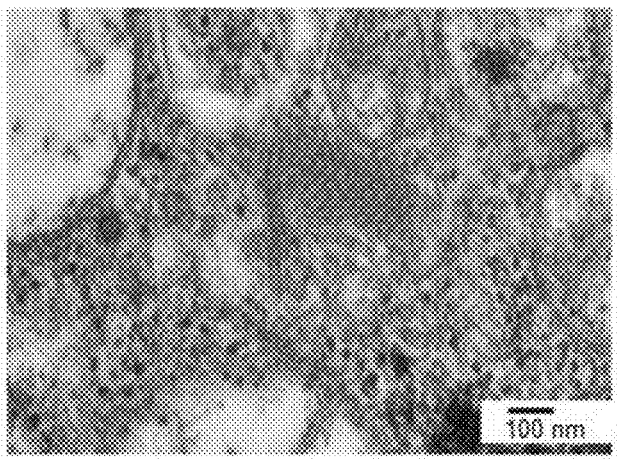
*FIG. 10A*  *FIG. 10B*
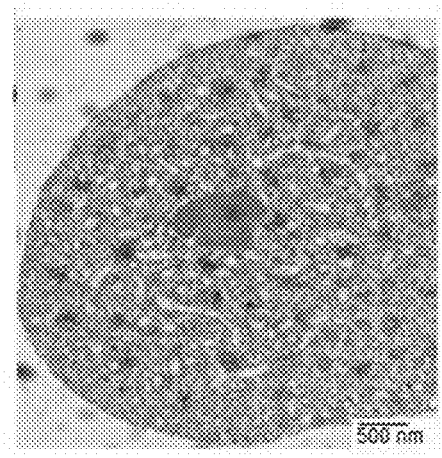 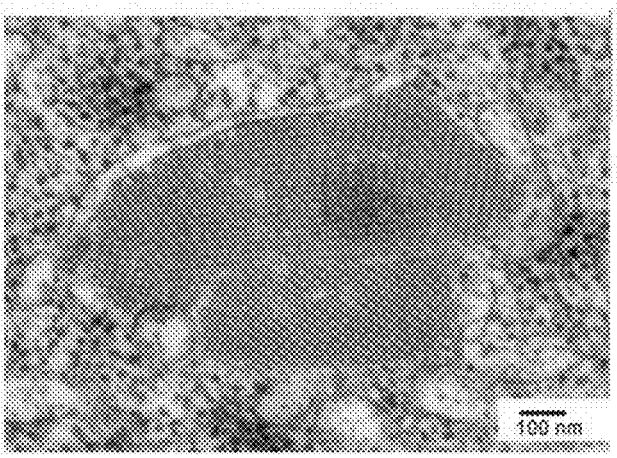
*FIG. 11A*  *FIG. 11B*

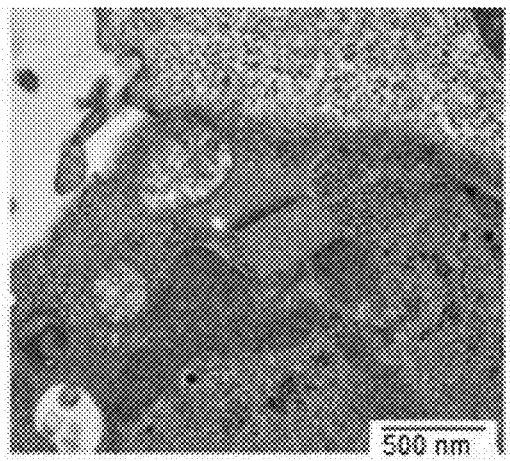 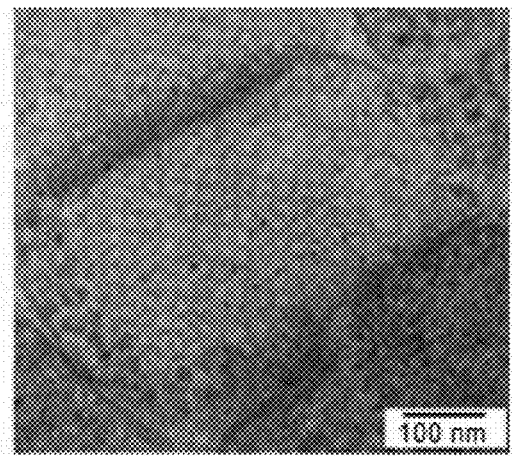
FIG.30A  FIG. 30B
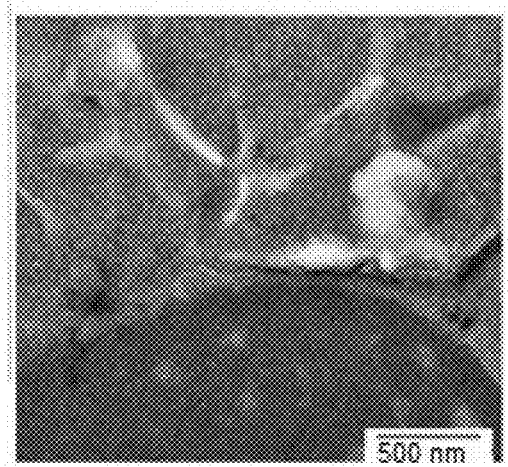 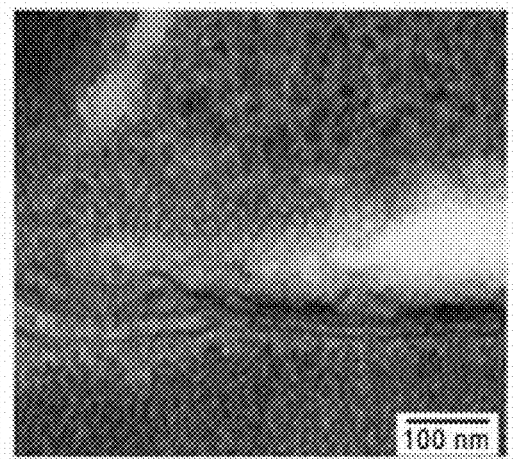
FIG.30C  FIG. 30D
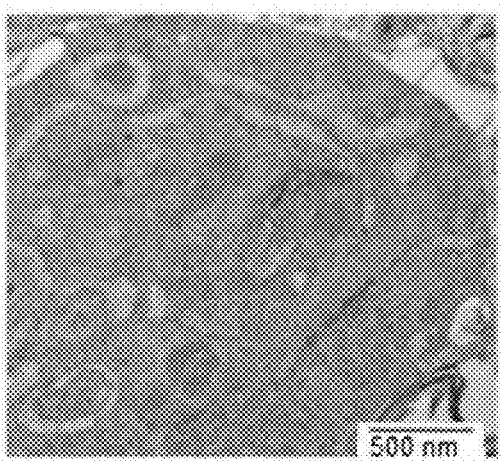 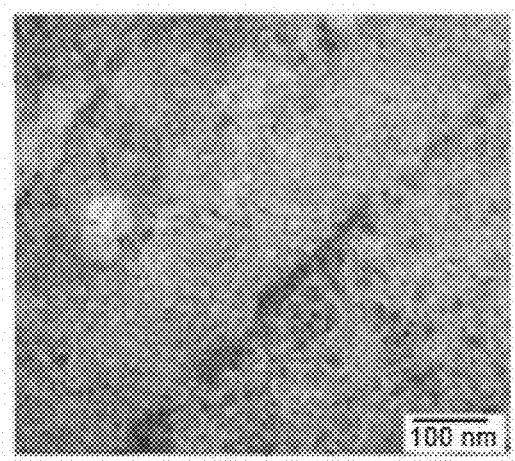
FIG.30E  FIG. 30F Harvested Supernatant from Infected SF21 cells F14 (VP0/VP2)  Anti-Rabbit VP3  12FE9 (VP1)

198kDa
98kDa
62kDa
49kDa
38kDa
28kDa
14kDa
6kDa
3kDa 1 2 3 4    1 2 3 4    1 2 3 4

Lane 1: Ladder
Lane 2: Negative Control Supernatant
Lane 3: Baculovirus expressing O1P1 3C (L127P) Supernatant
Lane 4: Baculovirus expressing O1P1 3C (L127P/C142T)-SGluc Supernatant

MODIFIED FOOT-AND-MOUTH DISEASE VIRUS 3C PROTEASES, COMPOSITIONS AND METHODS THEREOF

GOVERNMENT RIGHTS

This invention was made with government support under HSHQPM-12-X-00013 and HSHQDC-14-F-00035 awarded by the U.S. Department of Homeland Security. The United States Government has certain rights in this invention.

SEQUENCE LISTING

The instant application contains a Sequence Listing which has been submitted in ASCII format via EFS-Web and is hereby incorporated by reference in its entirety. The ASCII copy is named DHS-078_Sequence_Listing.txt and is 78 KB in size.

BACKGROUND

Field of the Invention

The present disclosure relates to foot-and-mouth disease virus (FMDV) 3C proteases that have been modified by mutating a polynucleotide sequence coding for the FMDV 3C protease. The modified FMDV proteases exhibit reduced cytotoxicity when expressed in host cells.

Description of Related Art

The "background" description provided herein is for the purpose of generally presenting the context of the disclosure. Work of the presently named inventors, to the extent it is described in this background section, as well as aspects of the description which may not otherwise qualify as prior art at the time of filing, are neither expressly or impliedly admitted as prior art against the present disclosure.

The foot-and-mouth disease virus (FMDV), a prototypic aphthovirus within the Picornaviridae family, is the causative agent of a highly infectious and sometimes fatal disease that affects cloven-hoofed animals such as cattle, pigs, sheep, goats, deer and other animals with divided hooves. There are seven major FMDV antigenically distinct virus serotypes (A, O, C, Asia 1 and South African Territories or SAT 1, 2 and 3) and multiple subtypes or topotypes exist within each serotype. Infection with any one serotype does not confer protective immunity against another. Serotype O is the most common serotype worldwide.

After an animal is infected with FMDV, the first signs of illness usually appear within 2 to 14 days. These usually include high fever for 2-3 days followed by blisters inside the mouth and on the feet that may rupture and cause lameness.

FMD outbreaks cause significant agro-economic losses and have severe implications for animal farming throughout much of the world. For example, the estimated costs attributable to the 2001 outbreak of FMD in the U.K. were £8 billion, including the costs slaughtering and sanitarily disposing of 6 million livestock. The virus causing the disease is highly contagious and can be spread by direct contact or through aerosols to uninfected livestock by infected livestock or by domestic or wild animals. FMDV may be also transmitted by contact with contaminated farming equipment, vehicles, clothing, or feed. Consequently, the containment of FMDV demands considerable effort and expense required for vaccination, vigilance and strict monitoring of livestock, or culling and disposal of infected livestock, as well as for accommodating transport and trade restrictions, quarantines and other administrative and legal issues.

The current most commonly used FMD vaccines utilize whole virus that has been killed, inactivated, and/or attenuated. A whole virus vaccine includes dozens of FMDV antigens to provide a broad spectrum of immunity against different FMDV strains and variants, including those arising due to antigenic drift or antigenic shift. However, this vaccine platform is fraught with many limitations and shortcomings. Animals immunized with the whole virus are difficult to distinguish from infected animals also exposed to the whole virus. The efficacy of the current vaccine formulations is limited by immunogenic instability and short vaccine shelf life that results in a loss of potency upon transporation or storage and subsequent induction of insufficient immunity or immunity of a short duration. Furthermore, the set-up and running costs of producing the current FMDV vaccine in potent form and securing and maintaining its production facilities are very high. For example, the mode of producing current FMDV vaccine raises safety concerns due to the possibility of virus escape from a vaccine production facility. Recombinant production of FMDV antigens, which could avoid the problems inherent to use of whole virus-based vaccines, is impeded by the promiscuous proteolytic activity of the FMDV 3C protease which is required for the processing of FMDV antigens from the FMDV P1 precursor polypeptide, but which also cleaves proteins in host cells used to express recombinant FMDV antigens. Native FMDV 3C protease is toxic to host cells and significantly reduces their ability to express immunogenic FMDV antigens in significant amounts.

There is a continuing need and interest in the development of new second or third generation vaccines that generate strong and stable protective immune responses against FMDV. With these objectives in mind, the inventors developed modifications to the FMDV 3C protease so that it can cleave and process FMDV precursor polypeptides to produce immunogenic FMDV antigens, but does not exert significant cytotoxic effects on the host cells used to express FMDV immunogens.

BRIEF SUMMARY OF THE INVENTION

The inventors have surprisingly discovered that the 3C protease can be engineered to maintain its ability to process and cleave the foot and mouth disease P1 polypeptide precursor into separate virus proteins and to simultaneously reduce its toxic, inhibitory, and other deleterious effects on a host cell used to express FMDV proteins which result in poor recombinant yields of P1 and processed viral proteins. Even more surprisingly, this has been accomplished by modifying a surface region of the FMDV 3C protease that is distal from the 3C active site and substrate binding cleft.

One aspect of the invention involves engineering a polynucleotide encoding a modified foot-and-mouth disease (FMDV) 3C protease which comprises one or more amino acid substitutions within residues 26-35, 125-134 or 138-150 of a wild-type FMDV 3C protease. The engineered polynucleotide may encode a modified FMDV 3C protease having additional substitutions outside of the residues described above, may encode a truncated 3C protease with terminal or internal deletions that do not remove its proteolytic activity, or may encode additional proteins or peptide or polypeptide segments besides the modified 3C protease, such as FMDV P1 precursor protein, one or more FMDV viral proteins, such as VP0, VP1, VP2, VP3, VP4, 2A, Δ1D2A, translation interrupter sequences, markers, reporters, or tags such as luciferase of FLAG or poly-His, or transcriptional or translational regulator elements. In one non-limiting embodiment, the engineered polynucleotide is produced by introducing one or more nucleotide point mutations into the codons encoding residues 26-35, 125-134 or 138-150 of a wild-type FMDV 3C protease and/or into other residues forming a wild-type $B_2$ β-strand of the 3C protease, for example, by mutating the codon encoding the leucine residue at position 127 to encode a proline residue (L127P).

An associated aspect of the invention is a vector or polynucleotide construct that comprises or contains a polynucleotide encoding an engineered polynucleotide containing one or more modified FMDV 3C proteases. Such a vector or polynucleotide construct may also comprise one or more polynucleotide sequences encoding FMDV P1 precursor protein, one or more FMDV viral proteins, such as VP0, VP1, VP2, VP3, VP4, 2A, Δ1D2A, translation interrupter sequences, markers or tags such as luciferase or FLAG. The vector may also comprise an origin of replication, one or more selectable markers, such as antibiotic resistance genes, as well as at least one promoter or other transcription regulatory element, prokaryotic or eukaryotic translation initiation sequence or other translation regulatory element, translational interrupter sequence, or reporter gene operatively linked to the polynucleotide sequence encoding the modified FMDV 3C protease or the FMDV P1 precursor polypeptide.

Another associated aspect of the invention is a host cell that has been transformed or transfected with a polynucleotide encoding the modified FMDV 3C protease or with the vector or polynucleotide constructs described above and that is capable of expressing the FMDV 3C protease, and in some embodiments, both the FMDV 3C protease and a FMDV P1 precursor polypeptide. In some embodiments the host cell will express both the modified FMDV 3C protease and the FMDV P1 precursor polypeptide, and permit processing of the FMDV P1 precursor polypeptide into viral proteins, such as FMDV VP0, VP3, and VP1 or into VP1, VP2, VP3 and VP4. A host cell according to an aspect of the invention may also be selected or engineered to provide for transport, secretion or assembly of recombinantly expressed viral proteins into quaternary structures such as virus-like particles.

Another aspect of the invention involves the recombinant production of FMDV P1 precursor polypeptide and processed viral proteins derived therefrom by action of the modified FMDV 3C protease. Such a method generally involves culturing a host cell according to an aspect of the invention in a suitable medium and recovering FMDV P1 precursor polypeptide, processed products of P1 such as VP0, VP1, VP2, VP3 or VP4, or processed and assembled quaternary structures of FMDV viral proteins, such as FMDV virus-like particles. Such methods are superior to conventional recombinant methods for expression of FMDV P1 or FMDV viral proteins because the modified FMDV 3C protease expressed is less toxic or inhibitory to host cell growth and expression of FMDV recombinant products. Such a method may also involve expression of a marker or indicator such as a luciferase that can be secreted to monitor or quantify expression of FMDV 3C protease, P1 precursor polypeptide or FMDV viral proteins or a tag to facilitate purification of such products.

The methods employing polynucleotide constructs or vectors encoding 2A or 2A-like protein sequences and/or *Gaussia* Luciferase (GLuc) or Secreted *Gaussia* luciferase (SGLuc) sequences represent another aspect of the invention. Such constructions may be employed to express and process polyproteins translated from an open reading frame such as but not limited to the FMDV P1 precursor protein. Individual proteins processed from longer proteins, such as precursor proteins, may be separately targeted to and quantified in different cellular or extracellular compartments. For example, SGLuc may be translated as part of a precursor protein adjacent to 2A or a 2A-like sequence which separates SGLuc from the polyprotein allowing it to be secreted from the host cell. The amount of luciferase secreted into the extracellular medium by a host cell may be used to detect, monitor or quantify the amount of transgene expression in the host cell. Polynucleotides expressing proteins comprising GLuc or SGLuc with, or without, translation interrupter sequences may be used to express proteins having luciferase activity. Such fusion proteins may comprise a GLuc 8990 mutation that stabilizes SGLuc luciferase expression in cell lysis buffer (30).

A modified FMDV 3C protease is another aspect of this invention. Such a modified protease will exhibit proteolytic activity on FMDV P1 precursor protein and will generally exhibit a reduction in one or more toxic or inhibitory properties associated with an unmodified FMDV 3C protease on a host cell used to recombinantly produce it. As described above, the modified FMDV 3C protease according to an aspect of the invention comprises one or more amino acid substitutions within residues 26-35, 125-134 or 138-150 of a wild-type FMDV 3C protease, but may contain additional modifications outside of these segments and may exhibit at least one proteolytic activity on FMDV P1 precursor polypeptide. In one or more embodiments, the modified FMDV 3C protease may contain cysteine residues at positions 51 and 163, contain FMDV 3C protease residues H46, D84 and C163, or the following substitutions or features: 126E, R126E or any non-native residue at position 126, A133, A133S or any non-native substitution at position 133. Other substitutions at residues 26-35, 46, 80, 84, 125-134, 138-150, 163 or 181 of a native 3C protease amino acid sequences may be made. These include, but are not limited to C163A, C163G, C163S, R126P, I128L, I128P, H46Y, H181Y, D80E, D84E, or D84N or combinations to two, three of more of these substitutions with other specific substitutions described herein. In other embodiments, the native bridging cysteine residues or all native cysteine and proline residues of the 3C protease are retained.

Proteolytic, antigenic or immunogenic products or compositions comprising the recombinant FMDV 3C protease or FMDV viral proteins or quaternary structures, such as FMDV virus-like particles, represent another aspect of the invention. Such compositions may contain one or more buffers suitable for activity of the modified FMDV 3C protease, or contain carriers, adjuvants, immune enhancers or other excipients suitable for administration of FMDV proteins, quaternary structures of FMDV viral proteins, or virus-like particles to a subject in need thereof. Such subjects generally include mammals susceptible to FMDV infection and may also include other animal or biological vectors of FMDV infection.

A cellular immunogen or vaccine comprising a host cell, preferably, an autologous, syngeneic or allogeneic host cell, that has been transformed to express the FMDV 3C protease according to the invention and, preferably, one or more other FMDV antigens, such as FMDV P1 precursor polypeptide represents another aspect of the invention. In one embodiment, the host cell may be administered to a subject as a live cell, attenuated cell (e.g., irradiated, fixed or chemicallytreated), or a cell that has been disrupted or fractionated (e.g., lysed, sonicated, French-pressed, sheared, freeze-thawed, or emulsified). In one embodiment, the immunogen or vaccine may be a host cell that when administered to a subject expresses in vivo a modified 3C protease and at least one FMDV antigen, such as P1 precursor polypeptide. Other kinds of host cells expressing modified 3C protease and/or P1 precursor polypeptide or other FMDV immunogens may also be administered, such as live yeast or bacterial cells capable of persisting in a subject's gastrointestinal tract.

Another aspect of the invention is a method for inducing an immune response against FMDV in a subject in need thereof, who may or may not have been exposed to FMDV. Such a method may include administration of at least one FMDV P1 precursor polypeptide, P1 polypeptide, VP0, VP1, VP2, VP3 or VP4 protein, a quaternary structure of FMDV virus proteins, or FMDV virus-like particles, such as those produced by the action of the modified FMDV 3C protease on an FMDV P1 precursor polypeptide. This method also includes administration of a cellular immunogen or cellular vaccine as described above. It may also involve administering a vector or polynucleotide construct encoding a FMDV P1 precursor polypeptide and modified 3C protease, which when expressed in the muscle or other somatic cells of an immunized subject preferably assemble into immunogenic quaternary or VLP structures. Such a method may also include administering a vector or polynucleotide construct encoding at least one of a FMDV P1 precursor polypeptide, P1 polypeptide, VP0, VP1, VP2, VP3 or VP4 protein, components of a FMDV virus-like particle or any other FMDV proteins or immunogens. A nucleic acid based vaccine may be linear, circular, supercoiled, and/or single or double stranded DNA or RNA. In one embodiment, a vector or polynucleotide construct encoding an immunogen or the vaccine according to the invention may be administered to a subject in need thereof along with a suitable carrier or adjuvant, for example, into muscle tissue.

The foregoing paragraphs provide a general introduction and are not intended to limit the scope of the following embodiments and claims which are best understood by reference to the following detailed description taken in conjunction with the accompanying drawings.

BRIEF DESCRIPTION OF THE DRAWINGS

An appreciation of the disclosure and many of the attendant advantages thereof may be understood by reference to the accompanying drawings. Included in the drawings are the following figures:

FIG. 2 depicts the positions of these three catalytic residues. Position 163, a cysteine residue in native 3Cprotease is labelled as A163 instead of C163. This substitution was made to remove 3C proteolytic activity to facilitate isolation of sufficient intact 3C protease for crystallographic analysis.

FIG. 3 identifies the positions of the triad of catalytic residues at positions 46, 84 and 163 in the amino acid sequence of the 3C protease of wild-type FMDV strain Asia Lebanon 89 (SEQ ID NO: 1). The relative positions of these catalytic residues are aligned with the known secondary structures of the 3C protein which are identified above the amino acid sequence.

FIG. 4A describes the amino acid sequence of the Δ1D2A translation interrupter sequence (SEQ ID NO: 120) which is involved in production of separate GLuc (a luciferase) and the 3C protease polypeptides. FIG. 4B provides a schematic diagram of this process and shows the relative position of the Δ1D2A sequence. During translation, the Δ1D2A sequence causes translational interruption which results in expression of a GLuc portion, which is secreted from a host cell into a cell medium, and the 3C protease portion both derived from the same ORF. Translation interruption induced by Δ1D2A occurs prior to the terminal proline (P) residue of the Δ1D2A sequence as shown by the arrow in FIG. 4A. Upon translation of this chimeric GLuc-2A protein, 29 amino acids of the translated Δ1D2A sequence remain attached to the C-terminus of GLuc and a single proline (P) residue from 2A remains attached to 3C as shown by the lighter box adjacent to the 3C protease on the lower schematic diagram in FIG. 4B.

FIGS. 9A-9G compare Western Blots of HEK-293-T cells expressing a 2A-SGLuc construct not expressing P1-3C (FIG. 9A), and P1-3C-SGLuc constructs expressing wild-type Asia Lebanon 1989 3C protease (FIG. 9B), and 3C modified at V28K (FIG. 9C), L127P (FIG. 9D), V141T (FIG. 9E), C142T (FIG. 9F) and at C163A (FIG. 9G). As indicated above the lanes of each figure, Western blots were probed with antibodies to VP2, VP3 or VP1. The P1 component was derived from the O1 Manisa serovar of FMDV while the 3C component was derived from the Asia Lebanon 1989 serovar of FMDV.

FIG. 9A is a Western blot image of lysate of HEK-293-T cells transfected with a 2A-SGLuc construct as a negative control for the examination of the ability of an FMDV 3C protease to process and cleave the P1 polypeptide protein precursor.

FIG. 9B is a Western blot image of lysate of HEK-293-T cells transfected with a O1P1-3C (wild-type)-SGLuc construct for the examination of the ability of the wild-type FMDV 3C protease to process and cleave the P1 polypeptide protein precursor.

FIG. 9C is a Western blot image of lysate of HEK-293-T cells transfected with a O1P1-3C(V28K)-SGLuc construct for the examination of the ability of the V28K mutant FMDV 3C protease to process and cleave the P1 polypeptide protein precursor.

FIG. 9D is a Western blot image of lysate of HEK-293-T cells transfected with an O1P1-3C(L127P)-SGLuc construct for the examination of the ability of the L127P mutant FMDV 3C protease to process and cleave the P1 polypeptide protein precursor.

FIG. 9E is a Western blot image of lysate of HEK-293-T cells transfected with a O1P1-3C(V141T)-SGLuc construct for the examination of the ability of the V141T mutant FMDV 3C protease to process and cleave the P1 polypeptide protein precursor.

FIG. 9F is a Western blot image of lysate of HEK-293-T cells transfected with a O1P1-3C(C142T)-SGLuc construct for the examination of the ability of the C142T mutant FMDV 3C protease to process and cleave the P1 polypeptide protein precursor.

FIG. 9G is a Western blot image of lysate of HEK-293-T cells transfected with an O1P1-3C(C163A)-SGLuc construct, as a negative control for the examination of the ability of an FMDV 3C protease to process and cleave the P1 polypeptide protein precursor.

FIG. 10A is a transmission electron microscope (TEM) image at 3000× magnification of HEK293-T cells expressing the O1P1-3C(wt)-SGLuc construct. FIG. 10B is a TEM image at 25,000× magnification of HEK293-T cells expressing the O1P1-3C(wt)-SGLuc construct. Crystal arrays of virus-like particles (VLPs) are seen in the center of FIG. 10B. VLPs were conventionally identified by recognition of their crystalline structure as confirmed by measuring a capsid size characteristic of FMDV VLPs.

FIG. 11A is a TEM image at 10,000× magnification of HEK293-T cells expressing the O1P1-3C(C142T)-SGLuc construct. FIG. 11B is a TEM image at 25,000× magnification of HEK293-T cells expressing the O1P1-3C(C142T)-SGLuc construct. Crystal arrays of virus-like particles (VLPs) are seen in the center of FIG. 11B.

FIG. 17 is an image of a western blot analysis utilizing an antibody which detects VP2 and showing the ability of the mutant L127P FMDV 3C protease to process the P1 polypeptide precursor in E. coli. Lane 3 depicts His-P1 protein, Lane 6 depicts induced His-P1 protein without induced 3C(L127P), and lane 7 shows processing of induced His-P1 by induced 3C(L127P). This His-tag is encoded by the polynucleotide sequence ATGGGCAGCAGCCATCATCATCATCATCACGGC (SEQ ID NO: 204) and has the amino acid sequence MGSSHHHHHHG (SEQ ID NO: 205).

FIG. 20B describes the luciferase readings from samples which have been adjusted to have approximately equal protein levels as depicted by western blots shown in FIG. 20A.

FIG. 24A is an IFA image of a DNA vector expressing SGLuc examined for VLP formation using ing formation of VLP crystal arrays. FIG. 30E is a TEM image of HEK293-T cells expressing the SAT2P1-3C (L127P/C142T)-SGLuc construct at 20,000× magnification, showing formation of VLP crystal arrays. FIG. 30F is a TEM image of HEK293-T cells expressing the SAT2P1-3C (L127P/C142T)-SGLuc construct at 50,000× magnification, showing formation of VLP crystal arrays.

FIG. 33A depicts EM images of bacteria at 20,000× magnification, and FIG. 33B depicts EM images of bacteria at 50,000× magnification. One plasmid encodes for the FMDV P1 polypeptide derived from the FMDV serovar O1 Manisa and the second plasmid encodes for the FMDV 3C(L127P) mutant derived from FMDV serovar Asia Lebanon 89.

FIG. 34 depicts expression and processing of FMDV O1 Manisa P1 polypeptide by either of two 3C protease mutants, L127P (lane 3) or L127P/C142T (lane 4), that were cloned into a baculovirus expression vector and expressed in SF21 cells. Specific antibodies recognized processed FMDV P1 components: VP0/VP2 (F14 antibody), VP3 (anti-rabbit VP3), or VP1 (12FE9 antibody).

FIGS. 36A and 36B provide transmission electron microscope (TEM) images of VLP crystal arrays in HEK293-T-cells expressing either the AsiaP1-3C(L127P)-SGLuc (FIG. 36A) or O1P1-3C(L127P)-SGLuc (FIG. 36B) constructs at 50,000× magnification.

DETAILED DESCRIPTION OF THE INVENTION

Definitions

Foot and Mouth Disease Virus

Figure 1:
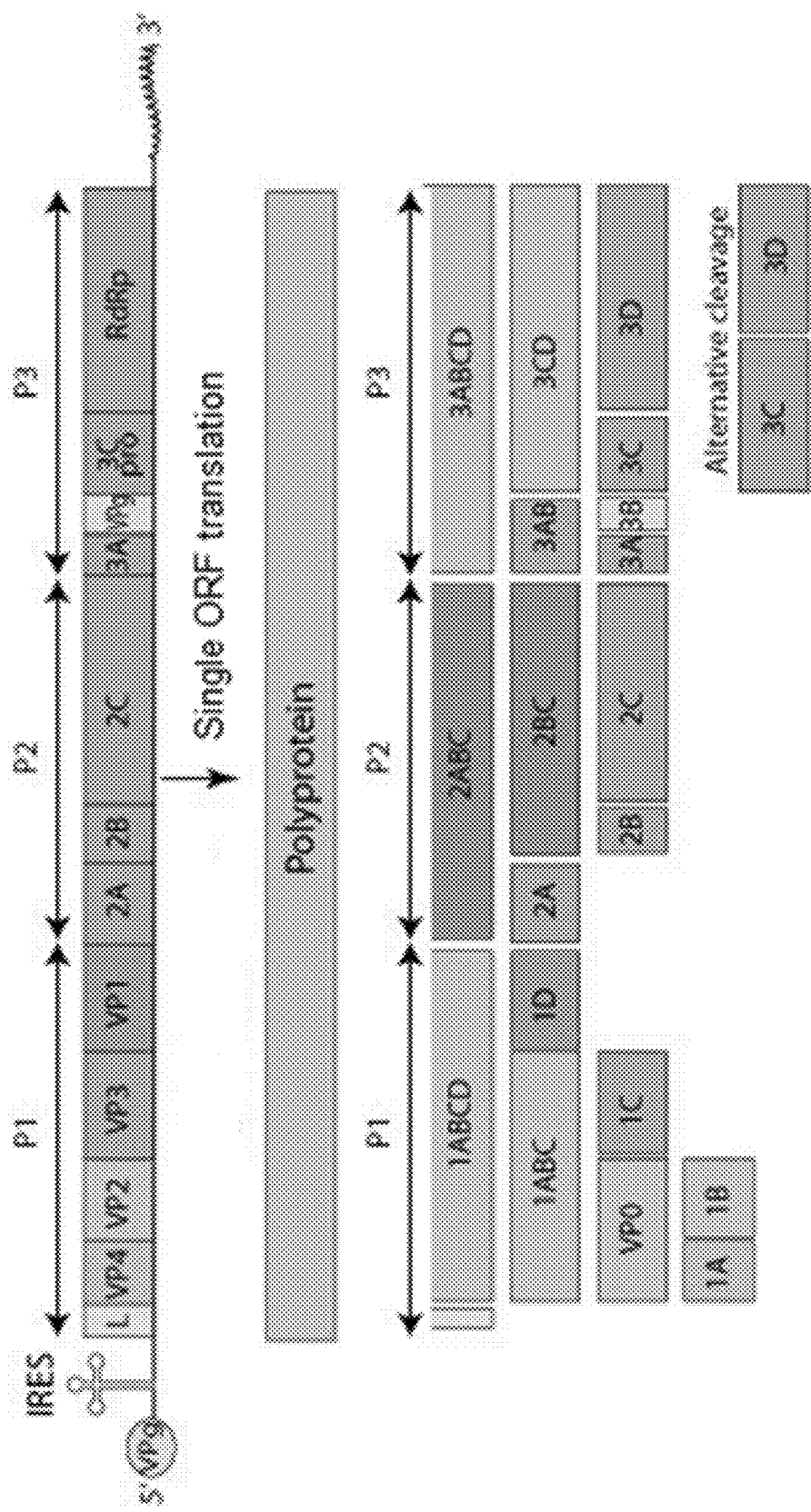
FIG. 1. The top line depicts the single open-reading frame (ORF) and associated genetic elements of a picornavirus RNA genome which encodes the viral polyprotein in a single ORF shown below it. The lower part of FIG. 1 describes processing of the polyprotein into intermediate precursor polypeptides and ultimately into individual viral proteins.

A "foot-and-mouth-disease virus" or the acronym FMDV refers to, but is not limited to, any of the seven major FMDV antigenically distinct virus serotypes, for example serotypes A, O, C, Asia 1 and South African Territories (SAT) 1, 2 and 3 as well as the multiple subtypes or topotypes which exist within each serotype.

FMDV Hosts/Animals Susceptible to FMDV Infection

The term "host" refers to a mammalian subject, especially but not limited to cloven-hooved livestock and wildlife (e.g. cattle, pigs, sheep, goats, water buffalos, yaks, reindeer, deer, elk, llamas, alpacas, bison, moose, camels, chamois, giraffes, hogs, warthogs, kudus, antelopes, gazelles, wildebeests) that are in need of treatment for foot-and-mouth disease (FMD). Hosts are in need of treatment for FMD when they are infected with one or more strains of the FMDV, have been diagnosed with FMD, or are otherwise at risk of contracting FMDV infection. Hosts that are "predisposed to" to FMD can be defined as hosts that do not exhibit overt symptoms of FMD but that are genetically, physiologically, or otherwise at risk of developing FMD.

Mutants

The terms "wild-type" or its acronym "wt", and native refers to a biological molecule that has not been genetically modified, for example, a nucleotide sequence encoding for an FMDV 3C protease that exists in nature and has not been genetically modified, an FMDV 3C protease translated from a coding nucleotide sequence that exists in nature and has not been genetically modified, a transgene expression cassette containing a nucleotide sequence encoding for an FMDV 3C protease that exists in nature and has not been genetically modified, and a vector carrying a mutant nucleotide sequence encoding for an FMDV 3C protease that exists in nature and has not been genetically modified or a transgene expression cassette containing a mutant nucleotide sequence encoding for an FMDV 3C protease that exists in nature and has not been genetically modified.

The term "mutation" as used herein indicates any genetic modification of a nucleic acid and/or polypeptide which results in an altered nucleic acid or polypeptide. Mutations include, but are not limited to point mutations, deletions, or insertions of single or multiple residues in a polynucleotide, which includes alterations arising within a protein-encoding region of a gene as well as alterations in regions outside of a protein-encoding sequence, such as, but not limited to, regulatory or promoter sequences. A genetic alteration may be a mutation of any type. For instance, the mutation may constitute a point mutation, a frame-shift mutation, a nonsense mutation, an insertion, or a deletion of part or all of a gene. In addition, in some embodiments of the modified microorganism, a portion of the microorganism genome has been replaced with a heterologous polynucleotide. In some embodiments, the mutations are naturally-occurring. In other embodiments, the mutations are identified and/or enriched through artificial selection pressure. It must be noted that all the mutations, modifications or alterations described in the present disclosure are the result of genetic engineering, and not naturally occurring mutations.

The terms "mutated", "mutant", "modified", "altered", "variant", and "engineered" are used interchangeably in the present invention as adjectives describing a nucleotide sequence, a nucleic acid, a protein or a protease. As a non-limiting example, a "mutated nucleotide sequence encoding for an FMDV 3C protease" or a "mutant nucleotide sequence encoding for an FMDV 3C protease" refers to a nucleotide sequence encoding for an FMDV 3C protease that is modified as defined above to be different from the wild-type nucleotide sequence encoding for an FMDV 3C protease which may or may not result in at least one of the following: one or more amino acid substitutions and shift in the open reading frame for the translated peptide product, which may be an FMDV 3C protease that folds properly (which may be functional or non-functional) or a non-functional peptide. In another non-limiting example, a "mutated FMDV 3C protease", a "mutant FMDV 3C protease", a "modified FMDV 3C protease" or an "altered FMDV 3C protease" refers to an FMDV 3C protease expressed from a mutated nucleotide sequence encoding for an FMDV 3C protease where the amino acid sequence has been altered, as compared to the wild-type FMDV 3C protease, by one or more amino acid substitutions or deletion of part of the protease (usually from the C-terminus), which may also lead to a change in one or more of the protein/protease properties, including but not limited to protein expression levels (e.g., transgene expression), substrate specificity, proteolytic activity towards FMDV polypeptide precursors, proteolytic activity towards host proteins, thermal stability, solubility, etc.

The term "mutant", when used herein as a noun, depending on the context, or the term "variant" refers to one of the following: a mutant nucleotide sequence encoding for an FMDV 3C protease, a mutant FMDV 3C protease, a transgene expression cassette containing a mutant nucleotide sequence encoding for an FMDV 3C protease, and a vector carrying a mutant nucleotide sequence encoding for an FMDV 3C protease or a transgene expression cassette containing a mutant nucleotide sequence encoding for an FMDV 3C protease. As a non-limiting example, a "C163A mutant", or a "3C(163A) mutant", depending on the context, refers to one of the following: a nucleotide sequence encoding for an FMDV 3C protease having the cysteine residue at position 163 being substituted with an alanine, an FMDV 3C protease having the cysteine residue at position 163 being substituted with an alanine, a transgene expression cassette containing a nucleotide sequence encoding for an FMDV 3C protease having the cysteine residue at position 163 being substituted with an alanine, and a vector carrying a nucleotide sequence encoding for an FMDV 3C protease having the cysteine residue at position 163 being substituted with an alanine or a transgene expression cassette containing a nucleotide sequence encoding for an FMDV 3C protease having the cysteine residue at position 163 being substituted with an alanine.

Polynucleotides/Vectors/Constructs/Genetic Expression

A "nucleotide" refers to an organic molecule that serves as a monomer, or a subunit of nucleic acids like DNA and RNA. Nucleotides are building blocks of nucleic acids and are composed of a nitrogenous base (e.g., A (adenine), G (guanine), C (cytosine), T/U (thymine/uracil), a five-carbon sugar (ribose or deoxyribose), and at least one phosphate group. Thus, a nucleoside plus a phosphate group yields a nucleotide. Nucleotides in a nucleotide sequence are commonly indicated based on their nitrogenous bases.

A "nucleotide sequence" or a "nucleic acid sequence" is a succession of letters that indicate the order of nucleotides or nucleic acids within a DNA (using GACT) or RNA molecule (using GACU). A DNA or RNA molecule or polynucleotide may be single or double stranded and may be genomic, recombinant, synthetic, a transcript, a PCR- or amplification product, an mRNA or cDNA. It may optionally comprise modified bases or a modified backbone. It may comprise a sequence in either a sense or antisense orientation and it inherently describes its complement.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

An "isolated polynucleotide" is a polynucleotide whether naturally occurring or recombinant, that is present outside the cell in which it is typically found in nature, whether purified or not. Optionally, an isolated polynucleotide is subject to one or more enrichment or purification procedures, e.g., cell lysis, extraction, centrifugation, precipitation, or the like.

A "coding region" or simply, a "region" of a gene consists of the nucleotide residues of the coding strand of the gene and the nucleotides of the non-coding strand of the gene which are homologous with or complementary to, respectively, the coding region of an mRNA molecule which is produced by transcription of the gene. A "coding region" of an mRNA molecule also consists of the nucleotide residues of the mRNA molecule which are matched with an anticodon region of a tRNA molecule during translation of the mRNA molecule or which encode a stop codon. The coding region may thus include nucleotide residues corresponding to amino acid residues which are not present in the mature protein encoded by the mRNA molecule (e.g., amino acid residues in a protein export signal sequence).

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Vectors/DNA Constructs/Genetic Expression

A "transgene expression cassette", a "transgene expression construct", an "expression cassette", an "expression construct", a "construct", a "chimera", a "chimeric DNA", a "DNA chimera" or a "chimeric gene" is a nucleic acid sequence that has been artificially constructed to comprise one or more functional units (e.g. promoter, control element, consensus sequence, translational frameshift sequence, protein encoding gene etc.) not found together in nature, and is capable of directing the expression of any RNA transcript in an organism that the cassette has been transferred to, including gene encoding sequence(s) of interest as well as non-translated RNAs, such as shRNAs, microRNAs, siRNAs, anti-sense RNAs. A transgene expression cassette may be single- or double-stranded and circular or linear. A transgene expression cassette can be constructed, inserted or cloned into a vector, which serves as a vehicle for transferring, replicating and/or expressing nucleic acid sequences in target cells.

A "promoter" is a region of DNA that initiates transcription of a particular gene or an expression cassette and is located near the transcription start sites of genes or expression cassettes, on the same strand and upstream on the DNA (towards the 5' region of the sense strand). A promoter can be about 100 to 1000 base pairs long.

A "vector" is any means by which a nucleic acid can be propagated and/or transferred between organisms, cells, or cellular components. Vectors include viruses, bacteriophage, pro-viruses, plasmids, phagemids, transposons, cosmids, viral vectors, expression vectors, gene transfer vectors, minicircle vectors, and artificial chromosomes such as YACs (yeast artificial chromosomes), BACs (bacterial artificial chromosomes), and PLACs (plant artificial chromosomes), and the like, that are "episomes," that is, that replicate autonomously or can integrate into a chromosome of a host cell. A vector typically contains at least an origin of replication, a cloning site and a selectable marker (e.g., antibiotic resistance). Natural versions of the foregoing non-limiting examples may be isolated, purified, and/or modified so the resultant natural version is differentiable from the material in its natural state. A vector can also be a naked RNA polynucleotide, a naked DNA polynucleotide, a polynucleotide composed of both DNA and RNA within the same strand, a polylysine-conjugated DNA or RNA, a peptide-conjugated DNA or RNA, a liposome-conjugated DNA, or the like, that are not episomal in nature, or it can be an organism which comprises one or more of the above polynucleotide constructs such as an *Agrobacterium* or a bacterium.

The term "recombinant vector" as used herein is defined as vector produced by joining pieces of nucleic acids from different sources.

A "minicircle DNA vector" may be referred to as "minicircle vector" or "minicircle" is a small (usually in the range of 3-4 kb, approximately 3-4 kb or usually no larger than 10 kb) circular, episomal plasmid derivative wherein all prokaryotic vector parts (e.g., bacterial origin of replication, genes associated with bacterial propagation of plasmids) have been removed. Since minicircle vectors contain no prokaryotic DNA sequences, they are less likely to be perceived as foreign and destroyed when they are employed as vehicles for transferring transgenes into target mammalian cells.

Transformation

"Transformation" refers to the process by which a vector or polynucleotide construct is introduced into a host cell. Transformation (or transduction, or transfection), can be achieved by any one of a number of means including chemical transformation (e.g. lithium acetate transformation), electroporation, microinjection, biolistics (or particle bombardment-mediated delivery), or *Agrobacterium* mediated transformation.

"Transfection" refers to the process by which a nucleic acid such as a gene cloned inside a vector (DNA or RNA) is delivered into a eukaryotic host cell.

Host Cell

The term "host cell" refers to a prokaryotic (e.g. bacterial) or a eukaryotic cell (e.g. mammalian, insect, yeast etc.) that is naturally infected or artificially transfected or transformed with a virus or a vector, for example, by vaccination. The virus introduced to the host cell may be live, inactivated, attenuated or modified, while the vector introduced carries a transgene expression cassette that, when expressed in the host cell, may produce viral structural proteins that self-assemble to form virus-like particles (VLPs). In some cases, a host cell may be inside of a host or subject and said host or subject may be treated by the administration of nucleic-acid-based vaccine encoding a modified FMDV 3C protease and at least one other FMDV antigen. A host cell may contain a polynucleotide encoding a modified 3C protease in its genomic or episomal DNA. For example, a modified FMDV 3C polynucleotide may be incorporated into a host cell genome via recombination, by use of a transposon, or by other recombinant DNA methods well known in the art. FMDV 3C protease and other FMDV antigens may also be expressed from the same or different plasmids, episomes, or other DNA or RNA constructs inside of a host cell.

A host cell for expression of FMDV 3C, FMDV P1 precursor protein, other FMDV proteins or antigenic sequences, as well as other proteins of interest may be a prokaryotic or eukaryotic cells. The term host cell includes yeast or fungal host cells, such as those of *Saccharomyces cerevisiae*, or *Pichia pastoris*; plant host cells, such as those of *Arabidopsis thaliana, Chlamydomonas reinhardtii, Glycine max, Nicotiana benthamiana, Nicotiana tabacum, Oryza sativa*, or *Zea mays*; insect cells or insect cell lines such as those of *Spodoptera frugiperda, Drosophila melanogaster*, Sf9, or Sf21; the cells of vertebrates or mammals or mammalian cell lines, such as HEK-293T (human kidney embryo) cell, LF-BK (porcine cell), LF-BK αV/β6, or cells of animals susceptible to FMDV infection; prokaryotic host cells such as those of gram-positive bacteria including cells of *Bacillus, Lactococcus, Streptomyces, Rhodococcus, Corynebacterium, Mycobacterium* or gram-negative bacteria such as *Escherichia* or *Pseudomonas*.

Amino Acids/Proteins/Polypeptide Structures

A "residue" or an "amino acid residue" refers to a specific amino acid within the polymeric chain of a peptide, a polypeptide or a protein. A residue may be one of the twenty two conventional proteinogenic amino acid residues (which include selenocysteine and pyrrolysine), a modified proteinogenic amino acid residue, or a non-proteinogenic amino acid residue.

An "amino acid sequence", a "peptide sequence" or a "protein sequence" refers to the order in which amino acid residues, connected by peptide bonds, like in the chain in peptides and proteins. The sequence is generally reported from the N-terminal end containing free amino group to the C-terminal end containing free carboxyl group. Peptide sequence is often called protein sequence if it represents the primary structure of a protein. Throughout the present disclosure, an amino acid residue may be represented by a three-letter code or a single-letter code, including but not limited to Ala (A) for alanine, Arg (R) for arginine, Asn (N) for asparagine, Asp (D) for aspartic acid, Cys (C) for cysteine, Gln (Q) for glutamine, Glu (E) for glutamic acid, Gly (G) for glycine, His (H) for histidine, Ile (I) for isoleucine, Leu (L) for leucine, Lys (K) for lysine, Met (M) for methionine, Phe (F) for phenylalanine, Pro (P) for proline, Ser (S) for serine, Thr (T) for threonine, Trp (W) for tryptophan, Tyr (Y) for tyrosine, Val (V) for valine, Pyl (O) for pyrrolysine, Sec (U) for selenocysteine.

As used herein, a "non-coded amino acid", a "non-proteinogenic amino acid", a "synthetic amino acid" or an "unnatural amino acid" refers to an amino acid that is not naturally encoded or found in the genetic code (DNA or mRNA) of any organism, and has to therefore be synthesized in vitro.

A "genetically coded amino acid", a "coded amino acid" or a "natural amino acid" refers to an amino acid that is naturally encoded by or found in the genetic code (DNA or mRNA) of an organism, such as alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, valine, pyrrolysine and selenocysteine.

The term "protein," "peptide," or "polypeptide" as used herein indicates an organic polymer composed of two or more amino acidic monomers and/or analogs thereof. As used herein, the term "amino acid" or "amino acidic monomer" refers to any natural and/or synthetic amino acids including glycine and both D- or L-optical isomers. The term "amino acid analog" refers to an amino acid in which one or more individual atoms have been replaced, either with a different atom, or with a different functional group. Accordingly, the term polypeptide includes amino acidic polymer of any length including full length proteins, and peptides as well as analogs and fragments thereof. A polypeptide of three or more amino acids is also called a protein oligomer or oligopeptide.

An "α-helix" or an "alpha-helix" is a form of regular secondary structure of proteins that is right-hand-coiled or spiral confirmation in which every backbone N—H group donates a hydrogen bond to the backbone C=O of the amino acid four residues earlier.

A "β-sheet", a "beta-sheet", a "β-pleated sheet" or a "beta-pleated sheet" is a form of regular secondary structure of proteins. β-sheets consist of a plurality of β-strands connected laterally by at least two or three backbone hydrogen bonds, forming a generally twisted, pleated sheet. Accordingly, a "β-sheet" or a "beta-sheet", is a stretch of polypeptide chain typically 3 to 10 amino acids long with backbone in an extended conformation.

A "β-ribbon", a "beta-ribbon", a "β-hairpin, a "beta hairpin", a "β-β unit" or a "beta-beta unit" is a simple protein structural motif involving two β-strands that look like a hairpin. The motif consists of two strands that are adjacent in primary structure, oriented in an anti-parallel direction (the N-terminus of one sheet is adjacent to the C-terminus of the next), and linked by a short loop of two to five amino acids. Beta hairpins can occur in isolation or as part of a series of hydrogen bonded strands that collectively comprise a β-sheet.

FMDV 3C protease. The FMDV 3C protease is a 213-amino acid, 23.1-kDa cysteine protease whose amino acid sequence is greater than 95% homologous across all known serotypes and strains of the virus. The cysteine-histidine-aspartic acid catalytic triad at the active site of the FMDV 3C protease, which is conserved in all cysteine proteases, is formed by the residues H46, D84 and C163. Structurally, the FMDV 3C protease adopts a chymotrypsin-like fold that consists of the N-terminus β-barrel domain and the C-terminus β-barrel domain (see FIG. 2). Each of the β-barrel domains is composed of a pair of four-stranded anti-parallel β-sheets that pack together to form a peptide or substrate binding cleft. The β-sheets are composed of: $B_1$, $A_1$, $D_1$, $E_1$ β-strands and $B_1$, $C_1$, $F_1$, $E_1$ β-strands for the N-terminus domain; and $B_2$, $A_2$, $D_2$, $E_2$ β-strands and $B_2$, $C_2$, $F_2$, $E_2$ β-strands for the C-terminus domain, where the B and E strands of each domain contributing to both β-sheets. Other secondary structures of the N-terminus and C-terminus β-barrel domains, in addition to the aforementioned β-strands, are loops or turns connecting the β-strands which include $A_1$-$B_1$, $A_2$-$B_2$, $B_1$-$C_1$, $B_2$-$C_2$, $C_1$-$D_1$, $C_2$-$D_2$, $E_1$-$F_1$, $E_2$-$F_2$ loops as non-limiting examples and the N-terminus, C-terminus α-helices, which are designated in FIG. 3 as $α_N$, $α_C$, respectively). FIG. 3 aligns the secondary structures of the FMDV 3C protease with their corresponding residues in the amino acid sequence.

Figure 2:
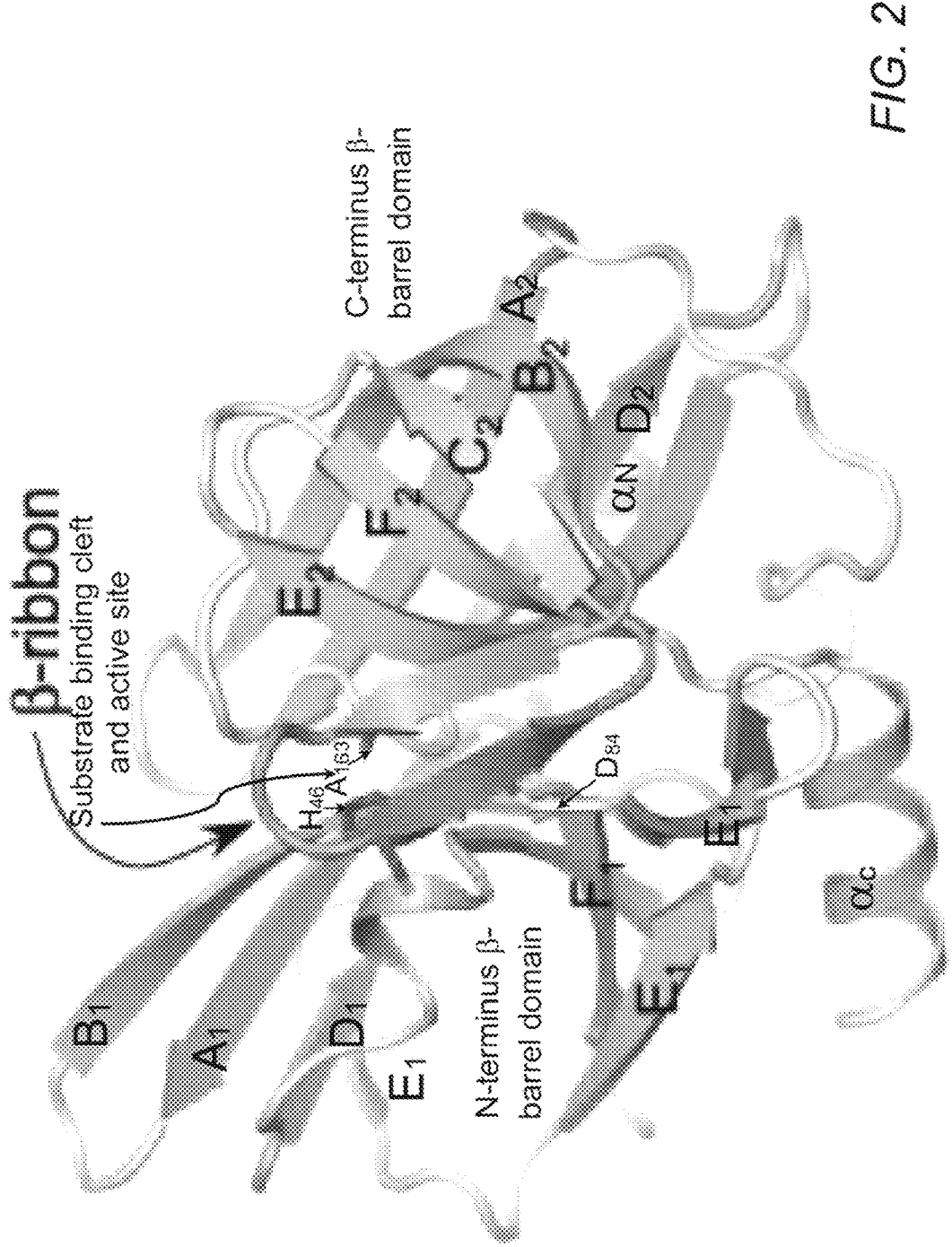
FIG. 2 is a ribbon diagram of an FMDV 3C protease crystal structure described by Protein Database identification 2j92, FMDV 3CP$^{pro}$ strain A10$_{61}$ which is incorporated by reference. The ribbon diagram depicts two β-barrel domains which are identified on each side of the diagram, a β-ribbon identified at the top center of the diagram and the location of the substrate binding cleft also identified at the top center of the diagram. The native FMDV 3C protease contains a catalytic triad of residues: H46, D84 and C163.

In addition to the two β-barrel domains, the FMDV 3C protease possesses another prominent tertiary structure in the form of a β-ribbon having a small β-sheet of two short anti-parallel β-strands and an apical loop connecting the two β-strands. As seen in FIG. 2, the β-ribbon folds over the substrate binding cleft and active site and contributes to substrate recognition and specificity. The β-ribbon including the two β-strands and the apical loop is formed by residues 138 to 150 of the FMDV 3C protease, as indicated in FIG. 3.

FMDV P1 precursor polypeptide (or P1 precursor protein) is a polypeptide comprised of the FMDV structural proteins and/or precursors, VP0, VP1, VP2, VP3, and VP4, as well as the 2A translational interrupter. The FMDV P1 precursor is around 85 kDa in molecular weight. The P1 precursor is processed by the FMDV 3C protease into structural proteins forming VLPs and the FMDV capsid.

The FMDV VP0 protein is a precursor peptide comprised of the FMDV VP2 and VP4 structural proteins. The FMDV VP0 protein is also identified as the FMDV 1AB protein and is around 33 kDa in molecular weight. It is produced by the processing of the FMDV P1 precursor protein by the FMDV 3C protease. The FMDV VP0 protein is important in the formation of protomers along with FMDV proteins VP3 and VP1. Five of these protomers assemble into a pentamer and twelve pentamers can assemble into a FMDV capsid or VLP. Cleavage of VP0 into VP2 and VP4 occurs through an unknown mechanism.

The FMDV VP1 protein is a structural protein which comprises the FMDV capsid and/or FMDV VLP. The FMDV VP1 protein is also identified as the FMDV 1D protein and is around 24 kDa in molecular weight. The FMDV VP1 protein contains a mobile loop structure, identified as the G-H loop, which emerges from the surface of the FMDV capsid and/or VLP. The FMDV VP1 protein can form a protomer along with VP0 and VP3. Five of these protomers assemble into a pentamer and twelve pentamers can assemble into a FMDV capsid or VLP.

The FMDV VP2 protein is a structural protein which comprises the FMDV capsid and/or FMDV VLP. The FMDV VP2 protein is also identified as the FMDV 1B protein and is around 24 kDa in molecular weight. The FMDV VP2 protein, along with the FMDV VP4 protein, is part of the FMDV VP0 protein until the formation of FMDV capsids and/or VLPs at which point the VP0 protein is processed into VP2 and VP4.

The FMDV VP3 protein is a structural protein which comprises the FMDV capsid and/or FMDV VLP. The FMDV VP3 protein is also identified as the FMDV 1C protein and is around 24 kDa in molecular weight. The FMDV VP3 protein can form a protomer along with VP0 and VP1. Five of these protomers assemble into a pentamer and twelve pentamers can assemble into a FMDV capsid or VLP.

The FMDV VP4 protein is the smallest of the FMDV structural proteins and is part of the FMDV capsid and/or FMDV VLP. The FMDV VP4 protein is also identified as the FMDV 1D protein and is around 9 kDa in molecular weight. The FMDV VP4 protein, along with the FMDV VP2 protein, is part of the FMDV VP0 protein until the formation of FMDV capsids and/or VLPs at which point the VP0 protein is processed into VP2 and VP4. Unlike other FMDV proteins which comprise the capsid and/or VLP the VP4 protein is entirely located inside the capsid and/or VLP structure.

"Virus-like particles" or "VLPs" resemble viruses, but are non-infectious because they do not contain any viral genetic material. The expression of viral structural proteins, such as envelope or capsid, can result in the self-assembly of VLPs that can stimulate an immune response in a mammalian organism. In other words, VLPs are often empty viral envelopes or empty viral capsids that are capable of stimulating an immune response like a full virus. Methods and problems associated with the production of VLPs in alternative systems include those described by Lee, et al., J. Biomed. Sci. 16:69 (Aug. 11, 2009), Srinivas, et al., Biologicals 44:64-68 (2016), Mayr, et al., Vaccine 19: 2152-2162 (2001) and Niborski, et al., Vaccine 24: 7204-7213 (2006) which are each incorporated by reference.

2A is an FMDV translation interrupter sequence, see Luke, et al, Biotech. Genetic Eng. Revs. 26:223-260 (2009) which is incorporated by references. A 2A polynucleotide sequence is described by nucleotides 34-87 of SEQ ID NO: 119 and by the amino acid residues encoded thereby. Other 2A sequences may conform to the amino acid motif described by SEQ ID NO: 193. 2A interrupters from other *Apthoviruses* may also be used.

Δ1D2A. A translation termination sequence that comprises FMDV 1D residues and the FMDV 2A amino acid residues. The polynucleotide sequence of SEQ ID NO: 119 encodes the Δ1D2A polypeptide of SEQ ID NO: 120. Other degenerate sequences encoding the polypeptide of SEQ ID NO: 120 may also be used. Polynucleotides 1-33 encode FMDV 1D residues, 34-87 encode the 2A amino acid residues, and 88-90 encode a C-terminal proline residue described by both SEQ ID NOS: 119 and 120. Other translation termination sequences similar to Δ1D2A may have fewer or more residues of the 1D protein than Δ1D2A or may contain 1, 2, 3 or more point mutations to the 2A sequence that do not affect is ability to act as a translation termination sequence. Δ1D2A will comprise the amino acid sequence PGP and may optionally comprise part or all of one of the following motifs:

```
                                            (SEQ ID NO: 206)
(H/R/Y/D)(K/R)(Q/T/F/V)(E/K/P/A/D)(I/P/L/A)(I/T/V)
(A/K/G/S)(P/V)(E/A/V)(K/R)Q(V/L/M/T)(L/C)(N/S)
FDLLKLAGDVESNPGP.

(SEQ ID NO: 207)
(A/V/I/L/M/T)(T/S/L/C)(N/S)(F/K)(D/S/E)LL(K/Q/L)
(Q/R/L)AGD(V/I)E(T/C/S)NPGP (SEQ ID NO: 208)
AGD(V/I)E(T/C/S)NPGP (SEQ ID NO: 211)
LLXXAGDXEXNPGP (SEQ ID NO: 212)
DXEXNPGP
```

GLuc. *Gaussia* luciferase gene (GLuc) or a protein expressed therefrom, including variants that are luciferous, such as proteinshaving, with at least 90, 95, or 99% sequence identity with a native GLuc protein. GLuc is a small, naturally secreted luciferase of 185 amino acids (SEQ ID NO: 201). GLuc has a higher intensity when compared to firefly or *Renilla* luciferases.

SGLuc. A *Gaussia* luciferase gene (GLuc) gene that expresses a secretory from of the luciferase or the SGLuc luciferase that can be secreted. A mutation of amino acids 89 and 90 in GLuc produces a super luminescent GLuc variant (SGLuc, SEQ ID NO: 203) useful for examination of low levels of protein expression.

Quaternary FMDV Protein structures. The FMDV VP1, VP0, and VP3 proteins can form a protomer structure consisting of a single copy of each protein. Five of these protomers, consisting of VP1, VP0, and VP3, can assemble into a pentamer structure.

Enzymes/Proteases

The term "enzyme" as used herein refers to any substance that catalyzes or promotes one or more chemical or biochemical reactions, which usually includes enzymes totally or partially composed of a polypeptide, but can include enzymes composed of a different molecule including polynucleotides. A protease (also called a peptidase or proteinase) is any enzyme that performs proteolysis.

"Cysteine proteases" are also known as thiol proteases. These protease degrade proteins via a catalytic mechanism that involves a nucleophilic cysteine in a catalytic triad or dyad. The FMDV 3C is a cysteine protease.

A "catalytic triad" or a "dyad" refers to the three amino acid residues that function at the center of an active site of some enzymes including proteases, amidases, acylases, lipases and β-lactamases, as an acid, a base and a nucleophile respectively. These three residues form a charge-relay network to polarize and activate the nucleophile, which attacks the substrate to form a covalent intermediate which is then hydrolyzed to regenerate free enzyme. The nucleophile is most commonly a serine or cysteine amino acid, but occasionally threonine.

FMDV 3C protease activity. The 3C protease cleaves the FMDV precursor protein at the positions shown in FIG. 7 to produce viral proteins VP0, VP3 and VP1. Other activities of the native 3C protease include suppression of host cell protein production, processing of host cell proteins, fragmentation of the Golgi apparatus, induction of the loss of microtubule system integrity, and induction of the loss of gamma-tubulin from the microtubule organizing center.

Prophylaxis/Treatment

As used herein, the terms "prevent" and "preventing" include the prevention of the recurrence, spread or onset. It is not intended that the present disclosure be limited to complete prevention. In some embodiments, prevention delays disease onset, reduces severity, reduces contagion, or otherwise alters disease symptoms and presentation.

As used herein, the terms "treat" and "treating" are not limited to the case where the subject (e.g. cattle) is cured and the disease is eradicated. Rather, embodiments of the present disclosure also contemplate treatment that delays disease progression, decreases particular symptoms, reduces contagion, or otherwise affects disease presentation or symptoms or progression. Prevention or treatment with a vaccine according to the invention may involve the induction of cellular (e.g., via T-cells) or humoral (e.g., via antibodies) immunity. Such a vaccine will usually contain one or more FMDV antigens produced by a host cell expressing a modified FMDV 3C protease. However, DNA-based vaccines that express FMDV 3C protease and other FMDV antigen(s) are also contemplated. The term "in vivo" referring to a reaction, such as but not limited to production of FMDV virus-like particles, gene expression (e.g. an FMDV polypeptide precursor, a wild-type or modified FMDV 3C protease, etc.), DNA transcription, mRNA translation, cleaving of an FMDV polypeptide precursor (e.g. P1, etc.), means that the reaction takes place within the environment of a living cell, such as a viral host cell. The living cell may be a living cell inside a host or other organism or in an artificial culture medium.

The term "in vitro" referring to a reaction, such as but not limited to production of FMDV virus-like particles, gene expression (e.g. an FMDV polypeptide precursor, a wild-type or modified FMDV 3C protease, etc.), DNA transcription, mRNA translation, cleaving of an FMDV polypeptide precursor (e.g. P1, etc.), means that the reaction takes place in any environment with the exception of a living cell, including not limited to a solution, a liquid/solid culture medium in a test tube, a flask, a petri dish, etc.

Sequence Homology/Identity/Similarity

The term "homolog" used with respect to an original enzyme or gene of a first family or species, refers to distinct enzymes or genes of a second family or species which are determined by functional, structural or genomic analyses to be an enzyme or gene of the second family or species which corresponds to the original enzyme or gene of the first family or species. Most often, homologs will have functional, structural or genomic similarities. Techniques are known by which homologs of an enzyme or gene can readily be cloned using genetic probes and PCR. Identity of cloned sequences as homolog can be confirmed using functional assays and/or by genomic mapping of the genes.

A protein has "homology" or is "homologous" to a second protein if the amino acid sequence encoded by a gene has a similar amino acid sequence to that of the second gene. Alternatively, a protein has homology to a second protein if the two proteins have "similar" amino acid sequences. Thus, the term "homologous proteins" is defined to mean that the two proteins have similar amino acid sequences.

A mutant, variant or modified polypeptide may have 75, 80, 85, 90, 95, 97.5, 98, 99, or 100% sequence identity or sequence similarity with a known FMDV polynucleotide or polypeptide sequence, such as those described herein and in the sequence listing.

BLASTN may be used to identify a polynucleotide sequence having at least 70%, 75%, 80%, 85%, 87.5%, 90%, 92.5%, 95%, 97.5%, 98%, 99% sequence identity to a reference polynucleotide. A representative BLASTN setting optimized to find highly similar sequences uses an Expect Threshold of 10 and a Wordsize of 28, max matches in query range of 0, match/mismatch scores of 1/−2, and linear gap cost. Low complexity regions may be filtered or masked. Default settings of a Standard Nucleotide BLAST are described by and incorporated by reference to blast.ncbi.nlm.nih.gov/_Blast.cgi?PROGRAM=blastn&BLAST_PROGRAMS=megaBlast&PAGE_TYPE=BlastSearch&SHOW_DEFAULTS=on&LINK_LOC=blasthome (last accessed Feb. 4, 2016).

BLASTP can be used to identify an amino acid sequence having at least 70%, 75%, 80%, 85%, 87.5%, 90%, 92.5%, 95%, 97.5%, 98%, 99% sequence identity, or similarity to a reference amino acid using a similarity matrix such as BLOSUM45, BLOSUM62 or BLOSUM80 where BLOSUM45 can be used for closely related sequences, BLOSUM62 for midrange sequences, and BLOSUM80 for more distantly related sequences. Unless otherwise indicated a similarity score will be based on use of BLOSUM62. When BLASTP is used, the percent similarity is based on the BLASTP positives score and the percent sequence identity is based on the BLASTP identities score. BLASTP "Identities" shows the number and fraction of total residues in the high scoring sequence pairs which are identical; and BLASTP "Positives" shows the number and fraction of residues for which the alignment scores have positive values and which are similar to each other. Amino acid sequences having these degrees of identity or similarity or any intermediate degree of identity or similarity to the amino acid sequences disclosed herein are contemplated and encompassed by this disclosure. A representative BLASTP setting that uses an Expect Threshold of 10, a Word Size of 3, BLOSUM 62 as a matrix, and Gap Penalty of 11 (Existence) and 1 (Extension) and a conditional compositional score matrix adjustment. Other default settings for BLASTP are described by and incorporated by reference to the disclosure available at: blast.ncbi.nlm.nih.gov/_Blast.cgi?PROGRAM=blastp&PAGE_TYPE=BlastSearch&LINK_LOC=blasthome (last accessed Jun. 29, 2016).

Techniques

A "polymerase chain reaction", or a "PCR", is a laboratory technique used to make multiple copies of a segment of DNA. PCR can be used to amplify, or copy, a specific DNA target from a mixture of DNA/mRNA/cDNA molecules. First, two short DNA/RNA sequences called primers are designed to bind to the start and end of the DNA target. Then, to perform PCR, the DNA/mRNA/cDNA template that contains the target is added to a tube that contains primers, free nucleotides, and an enzyme called DNA polymerase, and the mixture is placed in a PCR machine. The PCR machine increases and decreases the temperature of the sample in automatic, programmed steps. Initially, the mixture is heated to denature, or separate, the double-stranded DNA/mRNA/cDNA template into single strands. The mixture is then cooled so that the primers anneal, or bind, to the DNA template. At this point, the DNA polymerase begins to synthesize new strands of DNA starting from the primers. Following synthesis and at the end of the first cycle, each double-stranded DNA molecule consists of one new and one old DNA strand. PCR then continues with additional cycles that repeat the aforementioned steps. The newly synthesized DNA segments serve as templates in later cycles, which allow the DNA target to be exponentially amplified millions of times. A PCR can also be used to introduce one or more mutations and types of mutations to amplified copies of a DNA segment, such as but not limited to a site directed mutagenesis PCR.

The foot-and-mouth disease virus (FMDV) is a non-enveloped picornavirus (belonging to the genus *Aphthovirus* of the family Picornaviridae) with a single-stranded genomic RNA of between 7,500 to 8,000 nucleotides or approximately between 7,500 to 8,000 nucleotides, approximately 7,500 nucleotides, or approximately 8,000 nucleotides. Referring to FIG. 1, the FMDV RNA genome is translated in a single open reading frame as a single polypeptide precursor which must be cleaved into functional proteins by virally encoded proteases. Such cleavages take place at different stages as shown in FIG. 1, forming multiple intermediate polypeptide precursors and yielding the final protein products of capsid structural proteins VP1, VP2, VP3 and VP4, as well as non-structural proteins L, 2A, 2B, 2C, 3A, $3B_1$, $3B_2$, $3B_3$, 3C and 3D.

The most important of the virally encoded proteases is the 3C protease which is responsible for more than half of the required peptide cleavages, including the cleavage of the P1 polypeptide precursor into the capsid proteins VP0, VP3, and VP1 during capsid assembly. The FMDV capsid or protein shell is formed by assembly of 60 copies of each of the four structural proteins VP1-VP4.

Generating a strong protective immune response after vaccination against FMDV is associated with the delivery or assembly of FMDV capsids in the host. In principle, empty capsids produced by a molecular or DNA vaccine, which are non-infectious, can result in the self-assembly of recombinant virus-like particles (VLPs). However, the formation of stable VLPs in host cells at concentrations high enough to stimulate immune responses are severely hindered by the FMDV 3C protease because the proteolytic activity of the enzyme is not limited to processing of the viral peptides. It has been shown that FMDV 3C protease is able to induce proteolytic cleavage of several host proteins including histone H3, nuclear transcription factor kappa B essential modulator (NEMO), Src-associated substrate in mitosis of 68 kDa (SAM68), eukaryotic translation initiation factor 4A1 (eIF4AI), and eukaryotic translation initiation factor 4G (eIF4G). The presence of the 3C protease has also been shown to induce Golgi fragmentation and loss of microtubule system integrity of a host cell.

The present invention is based, in part, on modifications to a nucleotide sequence encoding a foot-and-mouth disease virus (FMDV) 3C protease that reduce or eliminate the toxicity of the expressed protease towards a host cell, compared to the wild-type FMDV 3C protease. Preferably and advantageously, these altered proteases retain their ability to fully process and cleave an FMDV P1 polypeptide precursor into individual capsid proteins VP1, VP2 VP3 and VP4 or VP0, VP1 and VP3 to allow subsequent assembly of these cleaved viral capsid proteins into an FMDV empty capsid in the host cell.

The inventors provide herein multiple mutagenic strategies for reducing or eliminating the toxicity of an FMDV 3C protease towards a host cell, while retaining the ability of the FMDV 3C protease to at least partially, preferably completely, process and cleave the P1 polypeptide precursor to form individual FMDV capsid proteins VP1, VP2, VP3 and VP4 or VP0, VP1 and VP3. Such non-limiting strategies include one or more point mutations to a nucleotide sequence encoding an FMDV 3C protease that would result in one or more amino acid or residue substitutions in the translated amino acid sequence, specifically one or more point mutations targeting one or more of $A_1$-$F_1$ and $A_2$-$F_2$ β-strands of the two β-barrel domains. Accordingly, a non-limiting example of a mutant FMDV 3C protease provided herein contains 1-12 amino acid substitutions in its amino acid sequence, as compared to the wild-type FMDV 3C protease, preferably 1-10, 1-8, 1-6 or 1-5 amino acid substitutions, more preferably 1-4 or 1-3 amino acid substitutions, most preferably 1 or 2 amino acid substitutions.

The modified 3C protease of the invention processes FMDV P1 precursor effectively while exhibiting reduced toxicity of host cells. This proteolytic activity as measured by cleavage of P1 at one or more sites may be more or less than a corresponding non-modified or native 3C protease. The modified 3C protease of the invention, as measured by the production of cleaved P1 precursor, may exhibit 10, 20, 30, 40, 50, 60, 70, 80, 90, 100, 110, 120, 130, 140, 150 or 200% of the proteolytic activity of a corresponding non-modified 3C protease. In one non-limiting example, the modified FMDV 3C protease exhibits at least 90% of the ability to cleave P1 compared to a corresponding unmodified or native 3C protease. This activity may be determined based on the relative ability of the modified 3C protease to perform one or more cleavages of P1, such as those producing VP0, VP1 and VP3 viral proteins, or in another embodiment or VP1, VP2, VP3 and VP4.

In other embodiments, the modified FMDV 3C protease may exhibit less than 100, 90, 80, 70, 60, 50, 40, 30, 20 or 10% of the proteolytic activity of the corresponding unmodified protease on one or more host cell proteins at one or more host protein target sites or on other co-expressed proteins, such as other polypeptide components of a multivalent vaccine while retaining a significant ability to process FMDV P1 precursor protein. In some embodiments, the modified FMDV 3C protease exhibits no higher than 10% proteolytic activity towards a host protein, including, but not limited to the eIF4AI translation factor.

In other embodiment, the growth rate of a host cell or the yield of at least one FMDV antigen for a transformed host cell will be increased by at least 1, 2, 3, 4, 5, 10, 20, 30, 40, 50, 60, 70, 80, 90, 100, 150, 200, 300% or more for a host cell in which the modified FMDV 3C protease is expressed compared to a host cell expressing the corresponding unmodified FMDV 3C protease.

In yet another embodiment, the viability or passage stability of a host cell (the ability of the host cell to stably maintain and express from passage-to-passage a nucleic acid encoding at least one FMDV antigen) expressing the modified FMDV 3C protease may be increased by 10, 20, 30, 40, 50, 60, 70, 80, 90, 100, 150, 200% or more compared to an otherwise identical host cell expressing the corresponding unmodified FMDV 3C protease.

The 3C polynucleotide sequence may be modified so as to introduce an amino acid substitution at position 127 of the 3C protease, such as a L127P substitution (i.e., the substitution of proline for leucine at position 127). A polynucleotide sequence encoding the 3C protease may also be modified so as to encode amino acid deletions, substitutions or additions at the positions corresponding to positions 138 to 150 of a wild-type 3C protease. These residues of the wild-type 3C protease form the β-ribbon of the protease, for example, such a modified polynucleotide sequence can encode a C142T substitution.

A wild-type FMDV protease polynucleotide sequence may be obtained from any of the seven major FMDV serotypes of O, A, C, Asia 1, SAT1, SAT2 and SAT3 or from any other wild-type FMDV. The same or similar modifications may be made to synthetic or engineered 3C polynucleotide sequences or to natural or engineered mutant 3C polynucleotide sequences. Moreover, the 3C polynucleotide sequences of attenuated, modified, or engineered FMDV strains may be further modified to contain the one or more nucleotide point mutations described above or the other modifications described herein.

Further modifications may be made to a polynucleotide sequence encoding a modified 3C protease. For example, prior to the transformation of a host cell, codon frequency of a polynucleotide sequence encoding FMDV 3C protease, or other FMDV antigens may be modified to optimize expression or stability of a nucleic acid encoding FMDV 3C protease, or other FMDV antigens. Software suitable for optimizing codon usage is known and may be used to optimize codon usage in nucleic acid encoding FMDV 3C protease, or other FMDV antigens, see Optimizer available at genomes._urv.cat (last accessed Feb. 5, 2016). Codon usage frequencies for various organisms are known and are also incorporated by reference to the Codon Usage Database on the world wide web at kazusa.or.jp (last accessed Feb. 5, 2016).

Not all amino acid codons are degenerate, for example, in the genetic code of most organisms, Met and Trp are encoded by single codons. However, for degenerate codons, frequency or average frequency of codon usage may be selected to range from 0% (no common degenerate codons) to 100% (same frequency of codon usage as host cell genome). This range includes all intermediate values include 0%, 10%, 20%, 30%, 40%, 50%, 60%, 70%, 80%, 90%, 95% and 100%. Similarly, G+C content of a nucleic acid encoding FMDV 3C protease or other FMDV antigens may be matched, moved closer or moved away from that of the host cell by selection of a degenerate codon with more or fewer G or C nucleotides. G+C content of exogenous nucleic acids encoding FMDV 3C protease or other FMDV antigens may range within 1, 2, 3, 4, 5, 6, 7, 8, 9, 10, 20, 30, 40, 50% more or less than the average G+C content of the host cell.

Alternatively, codon usage may be modified to modulate or control the expression of FMDV 3C protease or other FMDV antigens or to attenuate the expression of host cell proteins required for host cell viability, growth, or robustness; see for example, Kew, et al., U.S. Pat. No. 8,846,051 hereby incorporated by reference. In some embodiments, expression of FMDV 3C or FMDV antigens by a host cell may be limited or reduced by 5, 10, 20, 30, 40, 50, 60, 70, 80, 90, 95% or more compared to a maximum expression rate (e.g., where codon frequency is matched to the host cell) in order to permit aggregation of an antigen (e.g., into a quaternary structure) or a particular folding of an expressed protein (e.g., having a particular secondary or tertiary structure).

A vector may carry polynucleotides encoding modified FMDV 3C protease sequences and/or encoding FMDV P1 polypeptide precursors. The vector induces production of FMDV virus-like particles in a host cell when expressed in the host cell. In certain embodiments, the vector has a total transgene expression output in the host cell that is up to 20 times higher, relative to a vector expressing at least a wild-type FMDV 3C protease and the FMDV P1 polypeptide precursor in a host cell. In further embodiments, the vector has a total FMDV virus-like particle production in the host cell that is up to 20 times higher, relative to a vector expressing at least a wild-type FMDV 3C protease and the FMDV P1 polypeptide precursor in a host cell.

In one embodiment, the modified FMDV 3C protease and the FMDV P1 polypeptide precursor may be expressed in a single open reading frame or in separate reading frames.

A vector may further comprise a nucleotide sequence encoding a translation regulatory element. In one particular embodiment, the translation regulatory element is a translational interrupter sequence and the nucleotide sequence encoding therefor is positioned between the engineered nucleotide sequence encoding an engineered FMDV 3C protease and the nucleotide sequence encoding an FMDV P1 polypeptide precursor to allow the engineered FMDV 3C protease and the FMDV P1 polypeptide precursor to be independently expressed.

Polynucleotide sequences may be spliced or otherwise inserted into vectors or polynucleotide constructs which may further include a promoter sequence, a nucleotide sequence for initiation of eukaryotic translation, an enhancer sequence, or other sequence to facilitate or otherwise modulate or control expression of the FMDV 3C protease or other FMDV antigen.

A vector may be a mammalian expression vector. However, those of skill in the art will be able to select a suitable vector for expression of an FMDV antigen in a particular host cell. For example, a vector suitable for transformation and protein expression in an insect cell can be used to express FMDV antigens in an insect cell line such as Sf9, Sf21 or High Five insect cells. Other expression systems for FMDV 3C protease or FMDV antigens include those for yeast, such as *Saccharomyces cerevisiae* or *Pichia pastoris*, filamentous fungi, such as *Aspergillus, Trichoderma*, and *Myceliophthora thermophila*, non-lytic insect cell systems, such as Sf9, Sf21 from *Spodoptera frugiperda* cells, Hi-5 from *Trichoplusia ni* cells, and Schneider 2 cells and Schneider 3 cells from *Drosophila melanogaster*; plant expression systems, including tobacco, and other human or mammalian expressions systems, for example, from mice, rats, rabbits, hamsters, bovines, porcine, etc. Vectors or DNA constructs for expression of FMDV antigens in prokaryotes may also be used, such as those useful for expression in *E. coli, Bacillus, Corynebacterium*, or *Pseudomonas*. A minicircle or other kind of vector may be used to express a modified 3C protease.

An embodiment of the polynucleotide sequence encoding a modified 3C protease may also be engineered to place the structural genes encoding the 3C protease or other FMDV antigens under the control of one or more inducible promoter(s) to regulate the level of expression of the 3C protease or other FMDV antigens. For example, such promoters may be selected to optimize the concentrations of 3C protease and P1 precursor polypeptide and reduce exposure of a host cell to high levels of FMDV components which may slow host cell growth or its ability to express exogenous polypeptides. Such promoters are known and include those regulated by tetracycline, steroids, metals, alcohol and other organic compounds. The use of different promoters to express the protease and other FMDV antigens permits the control and optimization of the relative amounts of the FMDV 3C protease and other FMDV antigens, such as P1 protein precursor. For example, one may minimize the effects of an FMDV 3C protease on the host cell, by limiting the amount expressed to only that necessary to process the P1 protein precursor.

A host cell transformed or transfected with a vector encoding a modified 3C protease polynucleotide sequence and a FMDV P1 polypeptide precursor sequence may exhibit increased expression of FMDV antigens compared to an otherwise identical vector expressing a native 3C protease due to reduced toxicity of a modified 3C protease on host cells. Total transgene expression by a host cell expressing a modified 3C protease according to the invention can be increased by at least 1, 2, 3, 4, 5, 6, 7, 8, 9, 10, 11, 12, 13, 14, 15, 16, 17, 18, 19, 20 or more times compared to a host cell expressing the native 3C protease.

A host cell transformed or transfected with a vector encoding a modified 3C protease polynucleotide sequence and a FMDV P1 polypeptide precursor sequence also may exhibit increased production of FMDV virus-like particles, compared to an otherwise identical vector expressing a native 3C protease. Total FMDV virus-like particle formation by a host cell expressing a modified 3C protease according to the invention can be increased by at least 1, 2, 3, 4, 5, 6, 7, 8, 9, 10, 11, 12, 13, 14, 15, 16, 17, 18, 19, 20 or more times compared to a host cell expressing a native 3C protease.

An embodiment of the polynucleotide sequence encoding a modified 3C protease may be further modified to contain one or more other ancillary polynucleotide sequences that facilitate intracellular processing or trafficking of FMDV antigens expressed by a host cell, their aggregation, for example into VLPs, their secretion from a cell, or their identification, quantification or recovery, e.g. by co-expression of luciferase or other biological tags.

In further embodiments, a mutant FMDV 3C protease provided herein has the ability to process at least 90% of the total amount of an FMDV P1 polypeptide precursor expressed in a host cell, preferably at least 95%, more preferably at least 99%, even more preferably at least 99.9%, most preferably 99.9-100.0%.

In other embodiments, a mutant FMDV 3C protease provided herein has the ability to process at least 90% of the total amount of an FMDV polypeptide precursor other than the FMDV P1 polypeptide precursor. The FMDV polypeptide precursor other than the FMDV P1 polypeptide precursor may include the single FMDV polypeptide precursor translation product, and intermediate FMDV polypeptide precursors P2 (or 2ABC), P3 (or 3ABCD), 1ABCD, 1ABC, 2BC, 3AB, and 3CD. Modified or mutant FMDV 3C proteases according to the invention may be used to cleave or process native sites in native FMDV proteins or the same or similar 3C cleavage sites in non-FMDV proteins, such as proteins engineered to include FMDV 3C cleavage sites.

In some embodiments, a mutant FMDV 3C protease described herein will have decreased proteolytic activity toward the eIF4AI eukaryotic initiation factor compared to an otherwise identical unmodified FMDV 3C protease. A mutant FMDV 3C protease may degrade only 0.001, 0.01, 0.1, 1, 5, 10, 20, 30, 40, 50, 60, 70, 80, 90 or 95% of an eIF4AI eukaryotic initiation factor compared to an otherwise identical unmodified FMDV 3C protease. Preferably such decreased activity is no higher than 10% based on the total amount of eIF4AI expressed in a host cell, preferably no higher than 8%, more preferably no higher than 5%, even more preferably no higher than 1%, and most preferably 0.001-1.0%.

A modified FMDV 3C protease may exhibit a loss of activity towards at least one of histone H3, nuclear transcription factor kappa B essential modulator (NEMO), Src-associated substrate in mitosis of 68 kDa (SAM68) and/or eukaryotic translation initiation factor 4G (eIF4G). The modified protease may degrade only 0.001, 0.01, 0.1, 1, 5, 10, 20, 30, 40, 50, 60, 70, 80, 90 or 95% of at least one of histone H3, nuclear transcription factor kappa B essential modulator (NEMO), Src-associated substrate in mitosis of 68 kDa (SAM68) and/or eukaryotic translation initiation factor 4G (eIF4G) compared to an otherwise identical unmodified FMDV 3C protease In further embodiments, the ability of the FMDV 3C protease to induce Golgi fragmentation and loss of microtubule system integrity of a host cell is reduced or eliminated by the one or more mutations of the present disclosure.

Modification of the FMDV 3C protease may increase the expression output of a transgene expression cassette or a recombinant expression vector containing at least a mutant nucleotide sequence encoding a mutant FMDV 3C protease and a nucleotide sequence encoding an FMDV P1 polypeptide precursor. In some non-limiting embodiments, the transgene expression output is increased by up to 20 times, preferably 2-20 times, more preferably 5-15 times, even more preferably 10-15 times. When a host cell is transfected with a transgene expression cassette or a recombinant expression vector containing at least a mutant nucleotide sequence encoding a mutant FMDV 3C protease and a nucleotide sequence encoding an FMDV P1 polypeptide precursor, the increase in the transgene expression output would translate into an increase in the production of FMDV virus-like particles (VLPs) in a host cell.

In one embodiment, the transgene expression output is assessed by fusing a luminescent reporter gene to the transgene expression cassette, such as a *Gaussia* luciferase gene (GLuc) or a variant thereof including, but not limited to SGLuc and then measuring the number of relative light units (RLU) utilizing an integration time of 0.5 seconds on a luminometer. In some non-limiting embodiments, a recombinant expression vector containing a transgene expression cassette or a recombinant expression vector containing at least a mutant nucleotide sequence encoding a mutant FMDV 3C protease and a nucleotide sequence encoding an FMDV P1 polypeptide precursor has a transgene expression output in a host cell of $10^9$-$10^{10}$ RLU/0.5 s, preferably $2\times10^9$ to $8\times10^{10}$ RLU/0.5 s, and more preferably $4\times10^9$ to $3\times10^{10}$ RLU/0.5 s.

Mutations resulting in amino acid substitutions may be introduced into a mutant FMDV 3C protease of the invention using any methodology known to those skilled in the art. Mutations may be introduced randomly by, for example, conducting a PCR reaction in the presence of manganese as a divalent metal ion cofactor. In another embodiment, oligonucleotide directed mutagenesis may be used to create the modified FMDV 3C proteases which allows for all possible classes of base pair changes at any determined site along the encoding DNA molecule. In general, this technique involves annealing an oligonucleotide complementary (except for one or more mismatches) to a single stranded nucleotide sequence coding for the FMDV 3C protease of interest. The mismatched oligonucleotide is then extended by DNA polymerase, generating a double-stranded DNA molecule which contains the desired amino acid substitution in sequence in one strand. The double-stranded polynucleotide can then be inserted into an appropriate expression vector, and a mutant or modified polypeptide can thus be produced. The above-described oligonucleotide directed mutagenesis or site directed mutagenesis can, optionally, be carried out via PCR.

The nucleotide sequence encoding an FMDV 3C protease may be derived from any of the A, O, C, Asia 1, SAT1, SAT2 and SAT3 serotypes, as well as the subtypes, topotypes and strains within these seven serotypes. In some embodiments, the nucleotide sequence encoding an FMDV 3C protease includes but is not limited to SEQ ID NO: 1 (Asia Lebanon 89, serotype Asia 1), SEQ ID NO: 3 (O1 Manisa isolate 87 strain, serotype O), SEQ ID NO: 5 (O1 PanAsia), SEQ ID NO: 7 (A24 Cruzeiro iso71), SEQ ID NO: 9 (A Turkey 2006), SEQ ID NO: 11 (SAT2 Egypt 2010), SEQ ID NO: 13 (C3 Indaial), SEQ ID NO: 15 (SAT3 ZIM/6/91), SEQ ID NO: 17 (SAT1-20 iso11), and SEQ ID NO: 19 (Asia1 Shamir). SEQ ID NOS: 2, 4, 6, 8, 10, 12, 14, 16, 18 and 20 respectively describe the proteins encoded by SEQ ID NOS: 1, 3, 5, 7, 9, 11, 13, 15, 17 and 19.

One embodiment of the invention is a modified FMDV 3C protease that has been modified on a surface region that is distal from the substrate binding cleft and the proteolytic active site of the FMDV 3C protease. This embodiment involves the modification of the 3C protease in one or more domains, regions or segments distinct from sites known to participate in substrate recognition and proteolysis for the purpose of reducing toxicity of the 3C protease while maintaining its proteolytic activity on FMDV P1 precursor protein. To the surprise of the inventors, such modifications outside of known active sites had significant and advantageous effects on the specificity of the 3C protease.

In another embodiment the invention is directed to a polynucleotide or polynucleotide construct, such as a chimeric polynucleotide or expression vector, that encodes a polypeptide that is at least 70%, 80%, 90%, 95%, 96%, 97%, 98%, or 99% identical to the amino acid sequence of SEQ ID NO: 2, 4, 6, 8, 10, 12, 14, 16, 18 or 20 and that proteolytically cleaves foot-and-mouth disease virus (FMDV) P1 polypeptide, wherein said polypeptide contains one or more deletions, additions or substitutions in the positions corresponding to residues 28, 125 to 134, 142 and 163 of a polypeptide of SEQ ID NO: 2, 4, 6, 8. 10, 12, 14, 16, 18 or 20; wherein said protease exhibits decreased host cell toxicity when expressed in a host cell and/or increases the yield of at least one FMDV antigen when co-expressed with one or more polynucleotide sequences encoding FMDV antigen(s) in a host cell, compared to an otherwise identical polypeptide that does not contain the one more deletions, additions or substitutions in the positions corresponding to residues 26-35, 125-134 or 138-150, in some embodiments residues 28, 125 to 134, 142 and 163, of SEQ ID NO: 2, 4, 6, 8, 10, 12, 14, 16, 18 or 20.

Alternatively, said encoded polypeptide may differ from the amino acid sequence encoded by SEQ ID NO: 2, 4, 6, 8, 10, 12, 14, 16, 18 or 20 by 1, 2, 3, 4, 5, 6, 7, 8, 9, 10, 11, 12, 13, 14, 15, 20, 25, 30, 40, 50 or more amino acid deletions, substitutions or insertions as long as it exhibits decreased host cell toxicity when expressed in a host cell and/or increases the yield of at least one FMDV antigen or viral protein when co-expressed with one or more polynucleotide sequences encoding FMDV antigen(s) in a host cell compared to an otherwise identical polypeptide that does not contain the one more deletions, additions or substitutions in the positions corresponding to residues 28, 125 to 134, 142 and 163 of a native 3C protein.

Fragments of said encoded polypeptide, or hybrid or chimeric proteins containing such fragments, that differ from a polypeptide of SEQ ID NO: 2, 4, 6, 8, 10, 12, 14, 16, 18 or 20 by at least one deletion, substitution or addition of an amino acid residue are also contemplated as long as they retain the ability to proteolytically cleave FMDV P1 polypeptide and exhibit decreased host cell toxicity when expressed in a host cell and/or increases the yield of at least one FMDV antigen in a host cell, compared to an otherwise identical polypeptide fragment that does not contain the one more deletions, additions or substitutions in the positions corresponding to residues 26-35, 125-134 or 138-150 of a polypeptide of SEQ ID NO: 2, 4, 6, 8, 10, 12, 14, 16, 18 or 20.

In some embodiments, it is preferred that one or more point mutations are introduced to a region of the nucleotide sequence encoding an FMDV 3C protease, specifically a region encoding the $B_2$ β-strand of the FMDV 3C protease to result in one or more amino acid substitutions in the corresponding amino acid sequence forming the $B_2$ β-strand. The $B_2$ β-strand of the FMDV 3C protease is formed by residues 125 to 134 (10 residues) and therefore has a consensus amino acid sequence of GRLIFSG(D/E)AL (SEQ ID NO: 156).

Referring to FIG. 2, the 10 residues forming the $B_2$ β-strand of the FMDV 3C protease are surface residues of the protein molecule and are each at least 3.5 Å, preferably 5.0-20.0 Å, and more preferably 7.5-15.0 Å away from the substrate binding cleft and the active site of the protease as measured between a $B_2$ β-strand residue and any of the catalytic triad residues (i.e., H46, D84 and C163) and are therefore incapable of forming hydrogen bond or other chemical interactions with any residue at the substrate binding cleft or the active site. It is therefore unexpected that one or more amino acid substitutions in the $B_2$ β-strand would result in a mutant FMDV 3C protease that retains the ability to fully process the P1 polypeptide while dramatically enhancing transgene output and does not or minimally induces cytotoxicity to the host cell.

Preferably, one or more amino acids from residues 127 to 134 are modified. Residues 125 to 134 have a consensus amino acid sequence of GRLIFSG(D/E)AL (SEQ ID NO: 156). Any one of the residues 125 to 134 may be modified by another amino acid, where each amino acid modification is resulted by at least one nucleotide change in the codon encoding the residue. As a non-limiting example, glycine at position 125 (G125) may be substituted with an alanine, an arginine, an asparagine, an aspartic acid, a cysteine, a glutamine, a glutamic acid, a histidine, an isoleucine, a leucine, a lysine, a methionine, a phenylalanine, a proline, a serine, a threonine, a tryptophan, a tyrosine, a valine, or an unnatural amino acid; arginine at position 126 may be substituted with an alanine, an asparagine, an aspartic acid, a cysteine, a glutamine, a glutamic acid, a glycine, a histidine, an isoleucine, a leucine, a lysine, a methionine, a phenylalanine, a proline, a serine, a threonine, a tryptophan, a tyrosine, a valine, or an unnatural amino acid; leucine at position 127 (L127) may be substituted with an alanine, an arginine, an asparagine, an aspartic acid, a cysteine, a glutamine, a glutamic acid, a glycine, a histidine, an isoleucine, a lysine, a methionine, a phenylalanine, a proline, a serine, a threonine, a tryptophan, a tyrosine, a valine, or an unnatural amino acid. Isoleucine at position 128 (I128) may be substituted with alanine, an arginine, an asparagine, an aspartic acid, a cysteine, a glutamine, a glutamic acid, a glycine, a histidine, a leucine, a lysine, a methionine, a phenylalanine, a proline, a serine, a threonine, a tryptophan, a tyrosine, a valine, or an unnatural amino acid. Phenylalanine at position 129 (F129) may be substituted with an alanine, an arginine, an asparagine, an aspartic acid, a cysteine, a glutamine, a glutamic acid, a glycine, a histidine, an isoleucine, a leucine, a lysine, a methionine, a proline, a serine, a threonine, a tryptophan, a tyrosine, a valine, or an unnatural amino acid. Glycine at position 130 (G130) may be substituted with an alanine, an arginine, an asparagine, an aspartic acid, a cysteine, a glutamine, a glutamic acid, a histidine, an isoleucine, a leucine, a lysine, a methionine, a phenylalanine, a proline, a serine, a threonine, a tryptophan, a tyrosine, a valine, or an unnatural amino acid. Aspartic acid or glutamic acid at position 131 (D131 or E131) may be substituted with an alanine, an arginine, an asparagine, a cysteine, a glutamine, a glutamic acid (for D131) or an aspartic acid (for E131), a histidine, an isoleucine, a leucine, a lysine, a methionine, a phenylalanine, a proline, a serine, a threonine, a tryptophan, a tyrosine, a valine, or an unnatural amino acid. Alanine at position 132 (A132) may be substituted with an arginine, an asparagine, an aspartic acid, a cysteine, a glutamine, a glutamic acid, a glycine, a histidine, an isoleucine, a leucine, a lysine, a methionine, a phenylalanine, a proline, a serine, a threonine, a tryptophan, a tyrosine, a valine, or an unnatural amino acid. Leucine at position 130 (L130), like L127, may be substituted with an alanine, an arginine, an asparagine, an aspartic acid, a cysteine, a glutamine, a glutamic acid, a glycine, a histidine, an isoleucine, a lysine, a methionine, a phenylalanine, a proline, a serine, a threonine, a tryptophan, a tyrosine, a valine, or an unnatural amino acid.

More preferably, one or more amino acids from residues 127 to 130 (4 residues) are modified. Residues 127 to 130 have a consensus amino acid sequence of LIFS. As a non-limiting example, any one or more of the residues 127 to 130 may be substituted by another amino acid, where each amino acid substitution is resulted by at least one nucleotide change in the codon encoding the residue. For example, leucine at position 127 (L127) may be substituted with an alanine, an arginine, an asparagine, an aspartic acid, a cysteine, a glutamine, a glutamic acid, a glycine, a histidine, an isoleucine, a lysine, a methionine, a phenylalanine, a proline, a serine, a threonine, a tryptophan, a tyrosine, a valine, or an unnatural amino acid. Isoleucine at position 128 (I128) may be substituted with an alanine, an arginine, an asparagine, an aspartic acid, a cysteine, a glutamine, a glutamic acid, a glycine, a histidine, a leucine, a lysine, a methionine, a phenylalanine, a proline, a serine, a threonine, a tryptophan, a tyrosine, a valine, or an unnatural amino acid. Phenylalanine at position 129 (F129) may be substituted with an alanine, an arginine, an asparagine, an aspartic acid, a cysteine, a glutamine, a glutamic acid, a glycine, a histidine, an isoleucine, a leucine, a lysine, a methionine, a proline, a serine, a threonine, a tryptophan, a tyrosine, a valine, or an unnatural amino acid. Glycine at position 130 (G130) may be substituted with an alanine, an arginine, an asparagine, an aspartic acid, a cysteine, a glutamine, a glutamic acid, a histidine, an isoleucine, a leucine, a lysine, a methionine, a phenylalanine, a proline, a serine, a threonine, a tryptophan, a tyrosine, a valine, or an unnatural amino acid.

Most preferably, a modified FMDV 3C protease provided herein has the leucine residue at position 127 (L127) modified. As a non-limiting example, L127 may be substituted with an alanine, an arginine, an asparagine, an aspartic acid, a cysteine, a glutamine, a glutamic acid, a glycine, a histidine, an isoleucine, a lysine, a methionine, a phenylalanine, a proline, a serine, a threonine, a tryptophan, a tyrosine, a valine, or an unnatural amino acid, which is resulted by at least one nucleotide change in the codon encoding the L127 residue. Preferably, L127 is substituted with an alanine, an asparagine, an aspartic acid, a cysteine, a glutamine, a glutamic acid, a glycine, a histidine, a lysine, a phenylalanine, a proline, a serine, a threonine, a tryptophan and a tyrosine.

In one embodiment, the L127 of an FMDV 3C protease is substituted with a proline. The L127P substitution is resulted by any one of the following nucleotide changes in a leucine codon: TTA/TTG/CTT/CTC/CTA/CTG→CCT/CCC/CCA/CCG. In one embodiment, the L127P substitution is resulted by a single nucleotide change in CTG to CCG.

In a further embodiment, a mutant nucleotide sequence encoding a L127P mutant FMDV 3C protease is selected from but not limited to:

SEQ ID NO: 21 (L127P Asia Lebanon 89, serotype Asia 1),
SEQ ID NO: 23 (L127P O1 Manisa isolate 87 strain, serotype O),
SEQ ID NO: 25 (L127P O1 PanAsia),
SEQ ID NO: 27 (L127P A24 Cruzeiro iso71),
SEQ ID NO: 29 (L127P A Turkey/2006),
SEQ ID NO: 31 (L127P SAT2 Egypt 2010),
SEQ ID NO: 33 (L127P C3 Indaial),
SEQ ID NO: 35 (L127P SAT3 ZIM/6/91),
SEQ ID NO: 37 (L127P SAT1-20 iso11), and
SEQ ID NO: 39 (L127P Asia1 Shamir).

In another embodiment, the amino acid sequence of the L127P mutant FMDV 3C protease is selected from but not limited to:

SEQ ID NO: 22 (L127P Asia Lebanon 89, serotype Asia 1),
SEQ ID NO: 24 (L127P O1 Manisa isolate 87 strain, serotype O),
SEQ ID NO: 26 (L127P O1 PanAsia),
SEQ ID NO: 28 (L127P A24 Cruzeiro iso71),
SEQ ID NO: 30 (L127P A Turkey/2006),
SEQ ID NO: 32 (L127P SAT2 Egypt 2010),
SEQ ID NO: 34 (L127P C3 Indaial),
SEQ ID NO: 36 (L127P SAT3 ZIM/6/91),
SEQ ID NO: 38 (L127P SAT1-20 iso11), and
SEQ ID NO: 40 (L127P Asia1 Shamir).

In certain embodiments, it is preferred that the arginine residue at position 126 (R126) is not subjected to any amino acid modification. In other words, R126 is not substituted with an alanine, an asparagine, an aspartic acid, a cysteine, a glutamine, a glutamic acid, a glycine, a histidine, an isoleucine, a leucine, a lysine, a methionine, a phenylalanine, a proline, a serine, a threonine, a tryptophan, a tyrosine, a valine, or an unnatural amino acid. As a non-limiting example, a mutant FMDV 3C protease provided herein does not include a substitution of R126 with an acidic amino acid, such as aspartic acid and glutamic acid. More particularly, the mutant FMDV 3C protease does not include a substitution of R126 with a glutamic acid (i.e., R126E).

In certain embodiments, it is preferred that the alanine at position 133 (A133) is not subjected to any amino acid modification. In other words, A133 is not substituted with an arginine, an asparagine, an aspartic acid, a cysteine, a glutamine, a glutamic acid, a glycine, a histidine, an isoleucine, a leucine, a lysine, a methionine, a phenylalanine, a proline, a serine, a threonine, a tryptophan, a tyrosine, a valine, or an unnatural amino acid. As a non-limiting example, a mutant FMDV 3C protease provided herein does not include a substitution of A133 with a serine (i.e., A133S).

In some embodiments, one or more point mutations are introduced, instead of or in addition to one or more regions of the nucleotide sequence encoding an FMDV 3C protease other than the region encoding the $B_2$ β-strand. In certain embodiments, one or more point mutations are introduced, instead of or in addition to a region encoding the β-ribbon of the FMDV 3C protease to result in one or more amino acid substitutions in the corresponding amino acid sequence forming the β-ribbon, and/or a region encoding the $B_1$ β-strand of the FMDV 3C protease to result in one or more amino acid substitutions in the corresponding amino acid sequence forming the $B_1$ β-strand. As shown in FIG. 3, the β-ribbon of the FMDV 3C protease is formed by residues 138 to 150 (13 residues) and has an amino acid sequence of D(I/L)VVCMDGTMPF (SEQ ID NO: 157). The $B_1$ β-strand of the FMDV 3C protease is formed by residues 26 to 35 (10 residues) and has an amino acid sequence of KTVA(I/L)CCATF (SEQ ID NO: 158).

Preferably, one or more amino acids from residues 140 to 143 (4 residues) and/or residues 27 to 30 (4 residues) are modified. Residues 140 to 143 have an amino acid sequence of VVCM (SEQ ID NO: 159) while residues 27 to 30 have an amino acid sequence of TVAI (SEQ ID NO: 160). Any one of the residues 140 to 143 and 27 to 30 may be substituted by another amino acid, where each amino acid substitution is resulted by at least one nucleotide change in the codon encoding the residue. As a non-limiting example, valine at position 140 (V140) may be substituted with an alanine, an arginine, an asparagine, an aspartic acid, a cysteine, a glutamine, a glutamic acid, a glycine, a histidine, an isoleucine, a leucine, a lysine, a methionine, a phenylalanine, a proline, a serine, a threonine, a tryptophan, a tyrosine, or an unnatural amino acid. Valine at position 141 (V141), like V140, may be substituted with an alanine, an arginine, an asparagine, an aspartic acid, a cysteine, a glutamine, a glutamic acid, a glycine, a histidine, an isoleucine, a leucine, a lysine, a methionine, a phenylalanine, a proline, a serine, a threonine, a tryptophan, a tyrosine, or an unnatural amino acid. Cysteine at position 142 (C142) may be substituted with an alanine, an arginine, an asparagine, an aspartic acid, a glutamine, a glutamic acid, a glycine, a histidine, an isoleucine, a leucine, a lysine, a methionine, a phenylalanine, a proline, a serine, a threonine, a tryptophan, a tyrosine, a valine, or an unnatural amino acid. Methionine at position 143 (M143) may be substituted with an alanine, an arginine, an asparagine, an aspartic acid, a cysteine, a glutamine, a glutamic acid, a glycine, a histidine, an isoleucine, a leucine, a lysine, a phenylalanine, a proline, a serine, a threonine, a tryptophan, a tyrosine, a valine, or an unnatural amino acid. Threonine at position 27 (T27) may be substituted with an alanine, an arginine, an asparagine, an aspartic acid, a cysteine, a glutamine, a glutamic acid, a glycine, a histidine, an isoleucine, a leucine, a lysine, a methionine, a phenylalanine, a proline, a serine, a tryptophan, a tyrosine, a valine, or an unnatural amino acid. Valine at position 28 (V28), like V140 and V141, may be substituted with an alanine, an arginine, an asparagine, an aspartic acid, a cysteine, a glutamine, a glutamic acid, a glycine, a histidine, an isoleucine, a leucine, a lysine, a methionine, a phenylalanine, a proline, a serine, a threonine, a tryptophan, a tyrosine, or an unnatural amino acid. Alanine at position 29 (A29) may be substituted with an arginine, an asparagine, an aspartic acid, a cysteine, a glutamine, a glutamic acid, a glycine, a histidine, an isoleucine, a leucine, a lysine, a methionine, a phenylalanine, a proline, a serine, a threonine, a tryptophan, a tyrosine, a valine, or an unnatural amino acid. Isoleucine at position 30 (I30) may be substituted with alanine, an arginine, an asparagine, an aspartic acid, a cysteine, a glutamine, a glutamic acid, a glycine, a histidine, a leucine, a lysine, a methionine, a phenylalanine, a proline, a serine, a threonine, a tryptophan, a tyrosine, a valine, or an unnatural amino acid.

More preferably, one or more amino acids from residues at positions 141 and 142 (V141, C142) and/or residue at position 28 (V28) are modified. Any one of the residues V141, C142 and V28 may be substituted by another amino acid, where each amino acid substitution is resulted by at least one nucleotide change in the codon encoding the residue. As a non-limiting example, valine at position 141 (V141) may be substituted with an alanine, an arginine, an asparagine, an aspartic acid, a cysteine, a glutamine, a glutamic acid, a glycine, a histidine, an isoleucine, a leucine, a lysine, a methionine, a phenylalanine, a proline, a serine, a threonine, a tryptophan, a tyrosine, or an unnatural amino acid. Cysteine at position 142 (C142) may be substituted with an alanine, an arginine, an asparagine, an aspartic acid, a glutamine, a glutamic acid, a glycine, a histidine, an isoleucine, a leucine, a lysine, a methionine, a phenylalanine, a proline, a serine, a threonine, a tryptophan, a tyrosine, a valine, or an unnatural amino acid. Valine at position 28 (V28), like V141, may be substituted with an alanine, an arginine, an asparagine, an aspartic acid, a cysteine, a glutamine, a glutamic acid, a glycine, a histidine, an isoleucine, a leucine, a lysine, a methionine, a phenylalanine, a proline, a serine, a threonine, a tryptophan, a tyrosine, or an unnatural amino acid.

In one embodiment, a mutant FMDV 3C protease in accordance with the present invention contains a single amino acid modification where the residue at position 28 (V28) is substituted with a lysine. The V28K substitution is resulted by any one of the following nucleotide changes in a leucine codon: GTT/GTC/GTA/GTG→AAA/AAG). In one embodiment, the V28K substitution is resulted by a nucleotide change of GTG to AAG.

In a further embodiment, a mutant nucleotide sequence encoding a V28K mutant FMDV 3C protease is selected from but not limited to
SEQ ID NO: 41 (V28K Asia Lebanon 89, serotype Asia 1),
SEQ ID NO: 43 (V28K O1 Manisa isolate 87 strain, serotype O),
SEQ ID NO: 45 (V28K O1 PanAsia),
SEQ ID NO: 47 (V28K A24 Cruzeiro iso71),
SEQ ID NO: 49 (V28K A Turkey/2006),
SEQ ID NO: 51 (V28K SAT2 Egypt 2010),
SEQ ID NO: 53 (V28K C3 Indaial),
SEQ ID NO: 55 (V28K SAT3 ZIM/6/91),
SEQ ID NO: 57 (V28K SAT1-20 iso11), and
SEQ ID NO: 59 (V28K Asia1 Shamir).

In another embodiment, the amino acid sequence of the V28K mutant FMDV 3C protease is selected from but not limited to:
SEQ ID NO: 42 (V28K Asia Lebanon 89, serotype Asia 1),
SEQ ID NO: 44 (V28K O1 Manisa isolate 87 strain, serotype O),
SEQ ID NO: 46 (V28K O1 PanAsia),
SEQ ID NO: 48 (V28K A24 Cruzeiro iso71),
SEQ ID NO: 50 (V28K A Turkey/2006),
SEQ ID NO: 52 (V28K SAT2 Egypt 2010),
SEQ ID NO: 54 (V28K C3 Indaial),
SEQ ID NO: 56 (V28K SAT3 ZIM/6/91),
SEQ ID NO: 58 (V28K SAT1-20 iso11), and
SEQ ID NO: 60 (V28K Asia1 Shamir).

In one embodiment, a mutant FMDV 3C protease in accordance with the present invention contains a single amino acid substitution where the residue at position 141 (V141) is substituted with a lysine. The V141T substitution is resulted by any one of the following nucleotide changes in a leucine codon: GTT/GTC/GTA/GTG→ACT/ACC/ACA/ACG). In one embodiment, the V141T substitution is resulted by a nucleotide change of GTG to ACG.

In a further embodiment, a mutant nucleotide sequence encoding a V141T mutant FMDV 3C protease is selected from but not limited to:
SEQ ID NO: 61 (V141T Asia Lebanon 89, serotype Asia 1),
SEQ ID NO: 63 (V141T O1 Manisa isolate 87 strain, serotype O),
SEQ ID NO: 65 (V141T O1 PanAsia),
SEQ ID NO: 67 (V141T A24 Cruzeiro iso71),
SEQ ID NO: 69 (V141T A Turkey/2006),
SEQ ID NO: 71 (V141T SAT2 Egypt 2010),
SEQ ID NO: 73 (V141T C3 Indaial),
SEQ ID NO: 75 (V141T SAT3 ZIM/6/91),
SEQ ID NO: 77 (V141T SAT1-20 iso11),
SEQ ID NO: 79 (V141T Asia1 Shamir).

In another embodiment, the amino acid sequence of the V141T mutant FMDV 3C protease is selected from but not limited to:
SEQ ID NO: 62 (V141T Asia Lebanon 89, serotype Asia 1),
SEQ ID NO: 64 (V141T O1 Manisa isolate 87 strain, serotype O),
SEQ ID NO: 66 (V141T O1 PanAsia),
SEQ ID NO: 68 (V141T A24 Cruzeiro iso71),
SEQ ID NO: 70 (V141T A Turkey/2006),
SEQ ID NO: 72 (V141T SAT2 Egypt 2010),
SEQ ID NO: 74 (V141T C3 Indaial),
SEQ ID NO: 76 (V141T SAT3 ZIM/6/91),
SEQ ID NO: 78 (V141T SAT1-20 iso11),
SEQ ID NO: 80 (V141T Asia1 Shamir).

Most preferably, the cysteine residue at position 142 (C142) is modified, instead of or in addition to an amino acid substitution at the leucine residue at position 127 (L127). As a non-limiting example, cysteine at position 142 (C142) may be substituted with an alanine, an arginine, an asparagine, an aspartic acid, a glutamine, a glutamic acid, a glycine, a histidine, an isoleucine, a leucine, a lysine, a methionine, a phenylalanine, a proline, a serine, a threonine, a tryptophan, a tyrosine, a valine, or an unnatural amino acid, which is resulted by at least one nucleotide change in the codon encoding the C142 residue. L127 may be substituted with an alanine, an arginine, an asparagine, an aspartic acid, a cysteine, a glutamine, a glutamic acid, a glycine, a histidine, an isoleucine, a lysine, a methionine, a phenylalanine, a proline, a serine, a threonine, a tryptophan, a tyrosine, valine, or an unnatural amino acid, which is resulted by at least one nucleotide change in the codon encoding the L127 residue.

In one embodiment, a mutant FMDV 3C protease is a double mutant protease where residues at positions 127 (L127) and 142 (C142) have been substituted. As a non-limiting example, leucine at position 127 (L127) may be substituted with an alanine, an arginine, an asparagine, an aspartic acid, a cysteine, a glutamine, a glutamic acid, a glycine, a histidine, an isoleucine, a lysine, a methionine, a phenylalanine, a proline, a serine, a threonine, a tryptophan, a tyrosine, a valine, or an unnatural amino acid. Preferably, L127 is substituted with an alanine, an asparagine, an aspartic acid, a cysteine, a glutamine, a glutamic acid, a glycine, a histidine, a lysine, a phenylalanine, a proline, a serine, a threonine, a tryptophan and a tyrosine. Cysteine at position 142 (C142) may be substituted with an alanine, an arginine, an asparagine, an aspartic acid, a glutamine, a glutamic acid, a glycine, a histidine, an isoleucine, a leucine, a lysine, a methionine, a phenylalanine, a proline, a serine, a threonine, a tryptophan, a tyrosine, a valine, or an unnatural amino acid. Preferably, C142 is substituted with an alanine, a histidine, an isoleucine, a leucine, a methionine, a phenylalanine, a serine, a threonine or a tyrosine. More preferably, C142 is substituted with an alanine, a leucine, a serine or a threonine.

In one embodiment, a mutant FMDV 3C protease is a double mutant protease having the amino acid substitutions L127P and C142T. The L127P substitution is resulted by any one of the following nucleotide changes in a leucine codon: TTA/TTG/CTT/CTC/CTA/CTG→CCT/CCC/CCA/CCG). In one embodiment, the L127P substitution is resulted by a single nucleotide change in CTG to CCG. The C142T substitution is resulted by any one of the following nucleotide changes in a cysteine codon: TGT/TGC→ACT/ACC/ACA/ACG. In one embodiment, the C142T substitution is resulted by a nucleotide change of TGC to ACA.

In a further embodiment, a mutant nucleotide sequence encoding a L127P/C142T double mutant FMDV 3C protease is selected from but not limited to:

SEQ ID NO: 81 (L127P/C142T Asia Lebanon 89, serotype Asia 1),
SEQ ID NO: 83 (L127P/C142T O1 Manisa isolate 87 strain, serotype O),
SEQ ID NO: 85 (L127P/C142T O1 PanAsia),
SEQ ID NO: 87 (L127P/C142T A24 Cruzeiro iso71),
SEQ ID NO: 89 (L127P/C142T A Turkey/2006),
SEQ ID NO: 91 (L127P/C142T SAT2 Egypt 2010),
SEQ ID NO: 93 (L127P/C142T C3 Indaial),
SEQ ID NO: 95 (L127P/C142T SAT3 ZIM/6/91),
SEQ ID NO: 97 (L127P/C142T SAT1-20 iso11),
SEQ ID NO: 99 (L127P/C142T Asia1 Shamir).

In another embodiment, the amino acid sequence of the L127P/C142T double mutant FMDV 3C protease is selected from but not limited to:

SEQ ID NO: 82 (L127P/C142T Asia Lebanon 89, serotype Asia 1),
SEQ ID NO: 84 (L127P/C142T O1 Manisa isolate 87 strain, serotype O),
SEQ ID NO: 86 (L127P/C142T O1 PanAsia),
SEQ ID NO: 88 (L127P/C142T A24 Cruzeiro iso71),
SEQ ID NO: 90 (L127P/C142T A Turkey/2006),
SEQ ID NO: 92 (L127P/C142T SAT2 Egypt 2010),
SEQ ID NO: 94 (L127P/C142T C3 Indaial),
SEQ ID NO: 96 (L127P/C142T SAT3 ZIM/6/91),
SEQ ID NO: 98 (L127P/C142T SAT1-20 iso11),
SEQ ID NO: 100 (L127P/C142T Asia1 Shamir).

Transgene Expression Cassettes Comprising a Mutant Nucleotide Sequence Encoding a Mutant FMDV 3C Protease Another aspect of the present invention is directed to a transgene expression cassette containing a mutant nucleotide sequence encoding a mutant FMDV 3C protease as described herein. In one or more embodiments, the mutant nucleotide sequence is selected from those encoding a L127P mutant of FMDV 3C (SEQ ID NOS: 21, 23, 25, 27, 29, 31, 33, 35, 37, 39), a V28K mutant of FMDV 3C (SEQ ID NOS: 41, 43, 45, 47, 49, 51, 53, 55, 57, 59), V141T (SEQ ID NOS: 61, 63, 65, 67, 69, 71, 73, 75, 77, 79) and a L127P/C142T double mutant of FMDV 3C (SEQ ID NOS: 81, 83, 85, 87, 89, 91, 93, 95, 97, 99).

The structural gene/nucleic acid encoding the 3C protein may contain additional deletions, substitutions or insertions besides those described by the SEQ ID NOS: 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, for example, it may contain modifications to the polynucleotide sequence that alter the identities of 1, 2, 3, 4, 5, 6, 7, 8, 9, 10 or more amino acid residues in the FMDV 3C amino acid sequence outside of or distal to the substrate binding cleft of the catalytically active site of the FMDV 3C protease. Alternatively or additionally, such modifications to the polynucleotide sequence may alter the identities of amino acid residues in the two β-barrel domains or β-ribbon of the 3C protease or to residues in the substrate binding cleft or in the catalytic triad residues of H46, D84 and C163.

In another embodiment, the transgene expression cassette further includes a nucleotide sequence encoding the FMDV P1 polypeptide precursor. The nucleotide sequence encoding the P1 polypeptide precursor can be derived from any of the A, O, C, Asia 1, SAT1, SAT2 and SAT3 serotypes, as well as the subtypes, topotypes and strains within these seven serotypes or other FMDV isolates or variants. In some embodiments, the nucleotide sequence encoding an FMDV P1 polypeptide precursor is selected from but not limited to:

SEQ ID NO: 101 (O1 Manisa Iso87),
SEQ ID NO: 103 (O1 PanAsia),
SEQ ID NO: 105 (A24 Cruzeiro iso71),
SEQ ID NO: 107 (A Turkey/2006),
SEQ ID NO: 109 (SAT2 Egypt 2010),
SEQ ID NO: 111 (C3 Indaial),
SEQ ID NO: 113 (SAT3 ZIM/6/91),
SEQ ID NO: 115 (SAT1 KNP/196/91), and
SEQ ID NO: 117 (Asia1 Shamir).

The amino acid sequences of the P1 polypeptides encoded by the nucleotide sequences immediately above are described by SEQ ID NOS: 102, 104, 106, 108, 110, 112, 114, 116 and 118. A P1 polypeptide may be modified, for example, by deletion, substitution or insertion of 1, 2, 3, 4, 5, 6, 7, 8, 9, 10, 15, 20, or more amino acid residues provided that it retains or contains one or more epitopes, including both humoral and cellular epitopes, recognized by an animal's immune system (e.g., a FMDV mammalian host). Native P1 polypeptides are at least 62-100% homologous. In some embodiments a P1 polypeptide according to the invention may be described as one capable of processing and assembly into an FMDV capsid. A P1 polypeptide may also be structurally described as having 60, 70, 80, 90, 95, 96, 97, 98, 99, or 100% (or any intermediate value) identical or similar to any of the P1 polypeptides disclosed herein or to those known in the art.

In other embodiments, the nucleotide sequence encoding an FMDV P1 polypeptide precursor that is modified to remove internal restriction sites is selected from, but not limited to:

SEQ ID NO: 136 (O1 Manisa Iso87 restriction sites removed),
SEQ ID NO: 137 (O1 PanAsia restriction sites removed),
SEQ ID NO: 138 (A24 Cruzeiro iso71 restriction sites removed),
SEQ ID NO: 139 (A Turkey/2006 restriction sites removed),
SEQ ID NO: 140 (SAT2 Egypt 2010 restriction sites removed), SEQ ID NO: 141 (C3 Indaial restriction sites removed),
SEQ ID NO: 142 (SAT3 ZIM/6/91 restriction sites removed),
SEQ ID NO: 143 (SAT1 KNP/196/91 restriction sites removed), and
SEQ ID NO: 144 (Asia1 Shamir restriction sites removed).

In one embodiment, the transgene expression cassette of the present disclosure comprises a nucleotide sequence encoding the P1 polypeptide precursor that is derived from the O1 Manisa isolate 87 strain (SEQ ID NO: 101) and a mutant nucleotide sequence encoding the L127P mutant FMDV Asia Lebanon 89 protease of SEQ ID NO: 21. Such a transgene construct may be cloned into a vector or polynucleotide construct and transfected into a host cell.

In another embodiment of the present invention, mutagenesis strategies and techniques as described herein may be applied to introduce one or more mutations to the nucleotide sequence encoding the polypeptide precursor to enhance the stability of the final assembled capsid product. Among the mutations that can be introduced include, but are not limited to nonsense mutations that effectively eliminate restriction enzyme recognition sites to better facilitate cloning and sub-cloning yet maintain the same translated protein product by not causing any amino acid substitution. These mutations enhance the cloning in and cloning out of the P1 polypeptide precursor into a transgene expression cassette to swap different P1 polypeptide precursors from different FMDV serotypes to promptly respond to the needs of individual outbreaks.

In a further embodiment, the transgene expression cassette of the present disclosure further includes restriction enzyme recognition sites or sequences at each of the N-terminus and C-terminus of the expression cassette for cloning into an expression vector. Examples of these restriction enzyme recognition sites include but are not limited to recognition sequences for EcoRI, EcoRII, BamHI, HindIII, TaqI, NotI, HinFI, Sau3AI, PvuII, SmaI, NheI, HaeIII, HgaI, AluI, EcoRV, KpnI, PstI, SacI, SpeI, StuI, SphI, XbaI, SalI, ScaI, XcmI, BsiWI, XhoI, BstEII, PflMI, AccI, SacII, PpuMI, AgeI, NcoI, BstXI, MluI and AatI.

In another embodiment, the transgene expression cassette of the present disclosure comprises a nucleotide sequence encoding the P1 polypeptide precursor that is derived from the O1 Manisa isolate 87 strain (SEQ ID NO: 101) and a mutant nucleotide sequence encoding the L127P/C142T mutant FMDV protease of SEQ ID NO: 81 from Asia Lebanon 89. Such a transgene construct may be cloned into a vector or polynucleotide construct and transfected into a host cell.

The transgene expression cassette described in accordance with embodiments described herein does not encode the complete FMDV genome and therefore cannot cause an accidental FMD outbreak during manufacture, or administration of the vaccine containing the transgene expression cassette.

Furthermore, the transgene expression cassette encodes only one FMDV non-structural protein, i.e. a mutant FMDV 3C protease. Animals treated with a vaccine containing the transgene expression cassette will not produce antibodies to other FMDV non-structural proteins that are expressed during a natural FMDV infection. For example, if the transgene expression cassette contains a mutant nucleotide sequence encoding a mutant FMDV 3C protease it will only produce antibodies for the mutant FMDV 3C protease and not antibodies for other non-structural proteins such as 2B, 2C, 3B, 3D, etc. The difference in antibody profiles produced after natural infection compared to vaccination with the transgene expression cassette confers the ability to differentiate infected animals from vaccinated animals and vice versa.

In one embodiment, the transgene expression cassette according to the disclosure can be constructed as a single open reading frame. The nucleotide sequence encoding the P1 polypeptide precursor may be positioned 5' or 3' to the nucleotide sequence encoding a mutant FMDV 3C protease.

In certain embodiments, the transgene expression cassette further includes a translational regulatory element that is located between the nucleotide sequence encoding a P1 polypeptide precursor and the mutant nucleotide sequence encoding a mutant FMDV 3C protease to advantageously allow for individual, equimolar expression of the two proteins in a single open reading frame translation.

Figure 4:
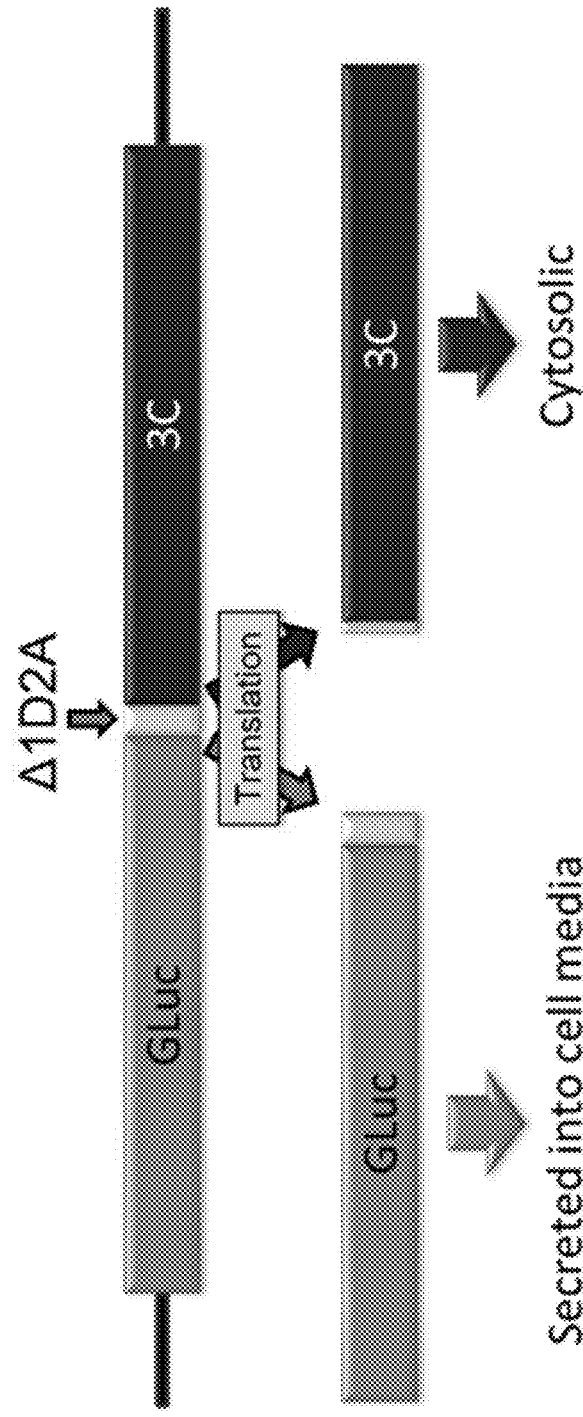
FIGS. 4A and 4B illustrate how the Δ1D2A translational interrupter sequence allows for expression of two separate peptides, GLuc and FMDV 3C protease, from a single open reading frame upon translation.

In some embodiments, the translational regulatory element is a translational interrupter sequence of 5 to 50 amino acid residues long, preferably 15 to 40 residues, more preferably 25 to 35 residues. In further embodiments, the translational interrupter sequence can contain portions of one or more FMDV non-structural proteins from any FMDV serotype (e.g., 1A, 1B, 1C, 1D, 2A, 2B, 2C, 3A, 3B, 3C, 3D). In one particular embodiment, the translational interrupter sequence is formed by incorporating an 11-amino acid of the C-terminus of the FMDV 1D protein to the 18-amino FMDV 2A protein and a proline residue to the C-terminus of the FMDV 2A protein, as shown in FIG. 4A.

In further embodiments, the nucleotide sequence encoding the translational interrupter sequence is SEQ ID NO: 119 and the amino acid sequence of the translational interrupter sequence is SEQ ID NO: 120. In other embodiments the translation interrupter may comprise the motif described by SEQ ID NO: 193 and 1, 2, 3, 4, 5, 6, 7, 8, 9, 10, 11, 12, 13, 14, 15, 16, 17, 18, 19, 20, 25, 30 or more non-2A residues such as C-terminal portions of FMDV 1D protein, or other portions of FMDV 1D, or FMDV viral proteins, or C-terminal portions of Aphthovirus 1D protein.

In some embodiments, the transgene expression cassette further includes a nucleotide sequence for initiation of translation in eukaryotes, such as a Kozak consensus sequence. In one non-limiting embodiment, the Kozak sequence includes the nucleotide sequence of SEQ ID NO: 161. In another non-limiting embodiment, the Kozak eukaryotic translation initiation sequence includes the nucleotide sequence of SEQ ID NO: 162. In one embodiment, the nucleotide sequence encoding the P1 polypeptide precursor is positioned 5' to the mutant nucleotide sequence encoding a mutant FMDV 3C protease, and the eukaryotic translation initiation sequence is positioned upstream or 5' to the nucleotide sequence encoding the P1 polypeptide precursor. In an alternative embodiment, the mutant nucleotide sequence encoding a mutant FMDV 3C protease is positioned 5' to the nucleotide sequence encoding the P1 polypeptide precursor, and the eukaryotic translation initiation sequence is positioned upstream or 5' to the mutant nucleotide sequence encoding a mutant FMDV 3C protease.

In further embodiments, the transgene expression cassette includes a promoter. Like the eukaryotic translation initiation sequence in certain embodiments, the promoter is positioned upstream or 5' to the nucleotide sequence encoding the P1 polypeptide precursor or the mutant nucleotide sequence encoding a mutant FMDV 3C protease, depending on the arrangement of the two nucleotide sequences encoding the P1 polypeptide precursor and the mutant FMDV 3C protease. In certain embodiments, strong and constitutive promoters such as but not limited to SV40, CMV, UBC, EF1A, PGK and CAG can be advantageously incorporated in the transgene expression cassette for prolonged high levels of transgene expression in mammalian hosts to induce a strong immune response.

In further embodiments, a stop codon sequence (e.g., TAA, TGA, or TAG) may be added to the end of the transgene expression cassette to ensure cessation of mRNA translation.

In one embodiment, a transgene expression cassette in accordance with the present disclosure is the "mpTarget O1P1-3C(L127P)" transgene that has a nucleotide sequence of SEQ ID NO: 121. In yet another embodiment, a transgene expression cassette in accordance with the present disclosure is the L127P/C142T transgene "mpTarget O1P1-3CDNA" that has a nucleotide sequence of SEQ ID NO: 122.

Recombinant Vectors Carrying the Transgene Expression Cassette

Another aspect of the present disclosure is directed to immunogenic compositions, including one in the form of recombinant vectors or vehicles containing the transgene expression cassette as described herein. Preferably, the transgene expression cassette is cloned into a mammalian expression vector system. In one embodiment, the transgene expression cassette is cloned into a modified pTarget vector acquired from Promega (mpTarget). In further embodiments, modifications to the pTarget vector include, but are limited to decreasing the overall vector size and/or removal of one or more restriction enzyme recognition sequences at the multiple cloning site. In one embodiment, an empty mammalian expression vector "mpTarget Empty" that has a nucleotide sequence of SEQ ID NO: 123. In another embodiment, a mammalian expression vector containing the transgene expression cassette insert "mpTarget O1P1-3CDNA" that has a nucleotide sequence of SEQ ID NO: 124. In yet another embodiment, a mammalian expression vector containing the transgene expression cassette insert "mpTarget O1P1-3CDNA2" that has a nucleotide sequence of SEQ ID NO: 125.

In one embodiment, the vector used for transferring the transgene expression cassette is a minicircle DNA vector. In a further embodiment, the minicircle DNA vector is a minicircle carrying a transgene expression cassette. In further embodiments, the minicircle DNA vector is a minicircle carrying a transgene expression cassette and does not contain an empty vector without an insert.

The use of a minicircle DNA vector to carry and transfer the transgene expression cassette allows mammalian cells to be transfected (e.g., directly) without utilizing an intermediate eukaryotic host system (e.g., insect cell line production system). Directly transfecting a mammalian cell with the minicircle DNA vector carrying the transgene expression cassette can eliminate the costs and labor associated with maintaining large volumes of intermediate host cell cultures in production facilities and harvesting empty capsids or virus-like particle (VLPs) produced by intermediate host cells.

Furthermore, minicircle vectors are typically smaller than standard plasmid vectors and lack of extraneous bacterial sequences, both of which enhance transfection of cells and enable an extended duration of transgene expression within the mammalian host cell. For example, a minicircle vector is smaller than a standard vector as it lacks extraneous bacterial sequences found on plasmids. Differences in size between plasmid vectors and minicircle vectors can be attributed to the lack of extraneous bacterial sequences, inclusion of an insubstantial amount of extraneous bacterial sequences in comparison to the overall size of the vector, such as appreciably smaller in comparison to the plasmid, and variations thereof.

In one or more embodiments, an empty minicircle vector has a nucleotide sequence of SEQ ID NO: 126. In a further embodiment, the minicircle containing the transgene expression cassette "Minicircle O1P1-3CDNA" that has a nucleotide sequence of SEQ ID NO: 127. In yet a further embodiment, the minicircle containing the transgene expression cassette "Minicircle O1P1-3CDNA" that has a nucleotide sequence of SEQ ID NO: 128.

Methods of producing minicircle vectors that are capable of inducing production of FMDV virus-like particles in mammalian host cells are also provided herein. In one embodiment, minicircle vectors are prepared using a two-step procedure. Firstly, a full-size parental plasmid containing bacterial sequences and transgene is produced in, for example, *Escherichia coli*. While the parental plasmid is still inside the *E. coli* host, the expression of a site-specific recombinase is induced and the prokaryotic or bacterial bone is excised by the enzyme at the recombinase recognition sites. Non-limiting examples of site-specific recombinases include Tyr- and Ser-recombinases such as Cre recombinase, Flp recombinase, ParA resolvase and PhiC31 integrase. An example of suitable materials, techniques, approaches, and methods are described in U.S. Pat. No. 8,236,548 which is hereby incorporated by reference in its entirety. Further description may be found in Kay et al, *A Robust System for Production of Minicircle DNA Vectors*, Nature Biotechnology, 28 1287-1289 (2010) which is hereby incorporated by reference in its entirety.

Transformed Host Cells

Another aspect of the present disclosure is directed to cells that are transformed or transfected with a recombinant vector carrying a transgene expression cassette expressing at least an FMDV P1 polypeptide precursor and a mutant FMDV 3C protease that is capable of fully processing the FMDV P1 polypeptide precursor into individual FMDV capsid proteins of VP1, VP2, VP3 and VP4 or VP0, VP1 and VP3 without causing toxicity to the transformed or transfected host cell. The host cells may be prokaryotic, such as bacterial cells, or eukaryotic. Preferably, the host cells are eukaryotic, such as but not limited to animal cells (particularly mammalian cells), plant cells and yeast cells. The host cells may be transformed using any conventional transformation techniques described herein. These cells may be grown under controlled conditions, generally outside of their natural environment prior to and/or post-transfection with the recombinant vector of the disclosure, such as in cell cultures, including but not limited to mammalian cell lines and insect cell lines. In one embodiment, the human embryonic kidney cell line HEK-293-T or the continuous porcine cell line LF-BK αV/β6 is used to host the recombinant vector carrying the transgene expression cassette. In an alternative embodiment, these cells are grown inside of their natural environment, for example, as part of an organism.

Foot-and-Mouth-Disease Virus Virus-Like Particles

Another aspect of the present disclosure is directed to FMDV virus-like particles (VLPs) and preparation methods thereof. VLPs are recombinant particles with viral matrix or structural proteins such as capsids that resemble viruses, but are non-infectious and unable to propagate as they, respectively, do not contain any viral genetic material. VLPs can be utilized as vaccine antigens as they mimic the native virions, and can be produced in vitro in a variety of cell culture systems including mammalian cell lines, insect cell lines, yeast and plant cells or in vivo.

In certain embodiments of the present invention, an FMDV VLP is produced when an FMDV P1 polypeptide precursor is contacted with a mutant FMDV 3C protease as described herein. In one embodiment, the FMDV P1 polypeptide precursor and the mutant FMDV 3C protease are co-expressed in vivo inside a host cell that is transformed with a recombinant vector carrying a transgene expression cassette containing at least a mutant nucleotide sequence encoding a mutant FMDV 3C protease and an FMDV P1 polypeptide precursor, wherein the expressed FMDV P1 polypeptide precursor is fully processed and cleaved by the expressed mutant FMDV 3C into individual FMDV capsid proteins of VP1, VP2, VP3 and VP4 or VP0, VP1 or VP3 and wherein these capsid proteins self-assemble to form FMDV VLPs, which are empty FMDV capsids. An FMDV VLP consists of one or more assembled capsid proteins. These FMDV VLPs may be isolated and purified from their host cells.

In alternative embodiments, FMDV VLP production does not require a living cell as a host cell, for example, when an FMDV P1 polypeptide precursor is cleaved by a mutant FMDV 3C protease in vitro. In further embodiments, FMDV VLP production in vitro includes, but is not limited to production in a test tube with appropriate solutions, buffers and/or cultural medium, or in a petri dish). The FMDV VLPs produced in this in vitro manner may also be isolated and purified from their environments.

FMD Vaccine Compositions and Methods of Vaccinating a Subject in Need Thereof

Another aspect of the present disclosure is directed to compositions and immunogenic preparations, including, but not limited to vaccine compositions comprising the FMDV VLPs of the present disclosure. In certain embodiments, the compositions and immunogenic preparations are capable of inducing protective immunity in a suitably treated host and a suitable carrier. In other certain embodiments, the compositions and immunogenic preparations are capable of inducing an immune response in the form of specific antibody production or in cellular immunity when injected into a host.

A foot-and-mouth disease vaccine (FMD vaccine) or a foot-and-mouth disease virus vaccine (FMDV vaccine) refers an immunogenic, biological composition that provides or improve immunity to one or more strains of the FMDV and to FMD. Such immunogenic compositions or vaccines are useful, for example, in immunizing hosts against infection and/or damage caused by the FMDV.

In certain embodiments, the vaccine preparations of the present disclosure can include an immunogenic amount of one or more FMDV VLPs isolated and purified from a host cell culture, fragment(s), or subunit(s) thereof. In other embodiments, the vaccines can include one or more FMDV capsid proteins and portions thereof, and adjuvant molecule and portions thereof on the surfaces of the FMDV VLPs, or in combination with another protein or other immunogen, including, but not limited to one or more additional FMDV viral components naturally associated with viral particles or an epitopic peptide derived therefrom.

An "immunogenic amount" is an amount capable of eliciting the production of antibodies directed against one or more strains of FMDV, in the host to which an FMDV immunogenic composition or an FMD vaccine has been administered.

In an alternative embodiment, the vaccine preparations of the present disclosure can include an immunogenic amount of one or more recombinant vectors carrying a transgene expression cassette expressing at least an FMDV P1 polypeptide precursor and a mutant FMDV 3C protease that is capable of fully processing the FMDV P1 polypeptide precursor into individual FMDV capsid proteins of VP1, VP2, VP3 and VP4 or VP0, VP1 and VP3 without causing toxicity to the transformed or transfected host cell. In a further embodiment, a host, which includes, but is not limited to a mammalian subject is protected against one or more strains of the FMDV by injecting it with genetically engineered DNA (e.g., transgene expression cassette+expression vector) to produce an immune response through assembly of FMDV VLPs in situ in the host.

There are a number of advantages associated with DNA vaccine platforms, in comparison to traditional whole-pathogen vaccines and protein-based vaccines. For example, DNA vaccines do not contain an actual infectious agent, whether dead or alive. DNA vaccines can also be easily lyophilized for long-term storage and transportation and do not require any cold chain delivery.

Additionally, the DNA vector inside a DNA vaccine can be produced and modified more quickly and more easily in comparision to traditional vaccine preparation. This allows a more rapid response to specifically engineer DNA vaccines tailored to individual FMD outbreaks, including, but not limited to a DNA vaccine matching a specific FMDV outbreak strain or serotype. In some embodiments, using a minicircle DNA vector to carry and transfer the transgene expression cassette eliminates the use of an intermediate eukaryotic host system and the associated costs and labor, including modification of an intermediate host system during an outbreak, such as during the onset of an FMD outbreak.

In one or more embodiments, the immunogenic compositions and/or vaccines of the present disclosure may be formulated by any of the methods known in the art. They can be typically prepared as injectables (e.g. subcutaneous, intradermal and intramuscular injection, jet injections) or as formulations for oral administration, intranasal administration (e.g. aerosol inhalation or instillation), topical administration to the eye, electroporation, gene gun, transfection, liposome-mediated delivery or combinations thereof, either as liquid solutions or suspensions. Solid forms suitable for solution in, or suspension in, liquid prior to injection or other administration may also be prepared. The preparation may also be emulsified or encapsulated in liposomes.

In one or more embodiments, the immunogenic compositions and/or vaccines of the present disclosure may be formulated as multivalent or polyvalent vaccines containing immunogenic compositions that stimulate an immune response towards two or more different strains of the same species or of different species. In a further embodiment, the multivalent vaccines of the present disclosure contain at least one FMDV VLP that is formed by FMDV capsid proteins processed by a mutant FMDV 3C protease of the present disclosure or a recombinant vector of the present disclosure. In a further embodiment, the multivalent vaccines may include other immunogenic compositions, including, but not limited to full microbes that are either live, killed, attenuated or inactivated; toxoids thereof; subunits thereof; VLPs thereof; conjugates thereof; or nucleic acids thereof.

In one or more embodiments, the active immunogenic ingredients, such as the FMDV VLP and recombinant vector, though not required, are often mixed with adjuvants, salts, carriers, excipients or diluents, which are pharmaceutically acceptable and compatible with the active ingredient.

In a further embodiment, adjuvants may be added to vaccine to modify the immune response by boosting it such as to give a higher amount of antibodies and a longer-lasting protection, thus minimizing the amount of injected foreign material. Adjuvants may also be used to enhance the efficacy of vaccine by helping to subvert the immune response to particular cells type of immune system, for example by activating the T cells instead of antibody-secreting B cells depending on the type of the vaccine. Example adjuvants include, but are not limited to, aqueous-based aluminum hydroxide gel-saponin, the oil-based Montanide ISA 206, other aluminum-based adjuvants, incomplete Freunds adjuvant (IFA), and paraffin oil.

In a further embodiment, suitable excipients include but are not limited to water, saline, dextrose, glycerol, ethanol, or the like and combinations thereof.

In a further embodiment, example diluents include, but are not limited to, water, physiological saline solution, human serum albumin, oils, polyethylene glycols, glycerin, propylene glycol or other synthetic solvents, antibacterial agents such as benzyl alcohol, antioxidants such as ascorbic acid or sodium bisulfate, chelating agents, such as ethylene diamine-tetra-acetic acid, buffers such as acetates, citrates or phosphates and agents for adjusting osmolarity, such as sodium chloride or dextrose.

In a further embodiment, example carriers include, but are not limited to, liquid carriers (e.g., water, saline, culture medium, saline, aqueous dextrose, aqueous glycols) and solid carriers (e.g., carbohydrates such as starch, glucose, lactose, sucrose, dextrans; anti-oxidants such as ascorbic acid and glutathione, hydrolyzed proteins).

In a further embodiment, pharmaceutically acceptable salts, include but are not limited to, the acid addition salts (formed with free amino groups of the peptide) which are formed with inorganic acids (e.g., hydrochloric acid or phosphoric acids) and organic acids (e.g., acetic, oxalic, tartaric, or maleic acid). Salts formed with the free carboxyl groups may also be derived from inorganic bases (e.g., sodium, potassium, ammonium, calcium, or ferric hydroxides), and organic bases (e.g., isopropylamine, trimethylamine, 2-ethylamino-ethanol, histidine, and procaine).

In a further embodiment, the vaccines may contain minor amounts of auxiliary substances such as wetting or emulsifying agents, pH buffering agents, and/or other agents, which enhance the effectiveness of the vaccine. Examples of agents which may be effective include, but are not limited to: aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetyl muramy 1-L-alanyl-D-isoglutaminy 1-L-alanine-2-(1'-2'-dipalmitoyl-sn-glycero-3-hydroxyphosphoryloxy)-ethyl amine (CGP 19835A, referred to as MTP-PE); and RIBI, which contains three components extracted from bacteria: monophosphoryl lipid A, trehalose dimycolate and cell wall skeleton (MPL+TDM+CWS) in a 2% squalene/Tween 80 emulsion. The effectiveness of the auxiliary substances may be determined by measuring the amount of antibodies (especially IgG, IgM or 19A) directed against the immunogen resulting from administration of the immunogen in vaccines which comprise the adjuvant in question. In a further embodiment, additional formulations and modes of administration may also be used.

In one or more embodiments, the FMD vaccines formulated with compositions and methods described herein may be administered prophylactically (e.g., to prevent or ameliorate the effects of a future infection), therapeutically (e.g., to treat or to empower the immune system of an infected organism) or both, in a manner compatible with the dosage formulation, and in such an amount and manner as will be prophylactically and/or therapeutically effective. The quantity to be administered for an FMDV VLP-based vaccine, is generally in the range of 1-1000 µg, preferably 5-500 µg, more preferably 50-250 µg, even more preferably 100-200 µg of pre-assembled FMDV VLPs per dose and/or adjuvant molecule per dose, depending on the subject to be treated, the capacity of the host immune system to synthesize antibodies, and the degree of protection desired. Precise amounts of the active ingredient required to be administered may depend on the judgment of the veterinarian or may be peculiar to each individual subject, but such a determination is within the skill of such a practitioner.

In an alternative embodiment, if formulated as an FMD DNA vaccine in accordance with embodiments of the present disclosure, the DNA vaccine is administered at dosages such as in the range of 25-1000 µg/µl of the a recombinant vector carrying the transgene expression cassette in saline solution, in the range of between 50-500 µg/µl, in the range of 100-250 µg/µl. Other factors that can form the basis of what dosage range to implement include but are not limited the size of the subject, how virulent the FMD strain that is being inoculated against is, and so forth factors that influence dosage amount. The FMD DNA vaccine and/or the method of vaccinating a mammalian subject with the vaccine protects the subject against one or more of the O, A, C, Asia 1, SAT1, SAT2 and SAT3 serotypes of the FMDV.

In a further embodiment, the vaccine or immunogenic composition may be given in a single dose; two dose schedule, for example two to eight weeks apart; or a multiple dose schedule. A multiple dose schedule is one in which a primary course of vaccination may include 1 to 10 or more separate doses, followed by other doses administered at subsequent time intervals as required to maintain and/or reinforce the immune response (e.g., at 1 to 4 10 months for a second dose, and if needed, a subsequent dose(s) after several months). Mammalian subjects immunized with the VLPs of the present disclosure are protected from infection by the cognate virus.

In one or more embodiments, FMD vaccines in accordance with the present disclosure are marker vaccines or DIVA (Differentiating Infected from Vaccinated Animals), which induce immune responses that differ from those from natural infection. These differences are reflected in antibody profiles, and can be detected by diagnostic tests and assays such as enzyme linked immunosorbent assays (ELISAs) containing the same compositions used in the vaccine formulations. The DIVA strategy is useful in eradication scenarios wherein emergency vaccination using DIVA FMD vaccines could be an effective control tool for FMD outbreaks in densely populated livestock areas. DIVA vaccination can limit the number of culled animals in the process of FMD eradication, thereby enhancing public acceptance for disease control measures and limiting economic losses.

An FMD DNA vaccine's efficacy in embodiments is considered the rate of reduction in the incidence of serotype-specific FMD among a population of subjects that have been vaccinated compared to the incidence in a population of unvaccinated subjects, over a duration of 12 months. Vaccine efficacy can be measured using the following formula:

$$VE = [(ARU - ARV)/ARU] \times 100\%$$

where "VE" is vaccine efficacy, "ARU" is an attack rate in an unvaccinated population and "ARV" is an attack rate in the vaccinated population.

In one or more embodiments, FMD DNA vaccines comprising the minicircle DNA vector in accordance with the present disclosure exhibit VE values of between 50-95%, approximately 50%, greater than 50%, 50%, approximately 75%, approximately 75%, greater than 75%, approximately 90%, greater than 90%, 95%, approximately 95%, or greater than 95%.

It is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

As used herein and in the appended claims, the singular forms "a", "an", and "the" include plural referents unless the context clearly dictates otherwise. Thus, for example, reference to "a cell" includes a plurality of such cells and reference to "the compound" includes reference to one or more compounds and equivalents thereof known to those skilled in the art, and so forth. Numerous embodiments of the invention, many of which involve the engineering of FMDV 3C protease variants, such as those that are less toxic to host cells used to express FMDV viral proteins or VLPs but which effectively process FMDV P1 protein, are disclosed.

One aspect of the invention is a polynucleotide that encodes a modified foot-and-mouth disease (FMDV) 3C protease that comprises one or more amino acid substitutions within residues 26-35, 125-134 or 138-150 of a wild-type FMDV 3C protease. Generally, such a polynucleotide will encode a modified FMDV 3C protease that is at least 70, 75, 80, 85, 90, 95, 96, 97, 98, or 99% similar or identical to at least one wild-type protease, such as a wild-type FMDV 3C protease from FMDV O serotype, A serotype, C serotype, Asia 1 serotype, SAT1 serotype, SAT2 serotype, or SAT3 serotype or that is at least 70, 75, 80, 85, 90, 95, 96, 97, 98, or 99% similar or identical to at least one wild-type polynucleotide sequence encoding a FMDV 3C protease selected from the group consisting of SEQ ID NOS: 1, 3, 5, 7, 9, 11, 13, 15, 17, and 19 or that encodes a modified FMDV 3C protease that is at least 70, 75, 80, 85, 90, 95, 96, 97, 98, or 99% similar or identical to at least one wild-type FMDV 3C protease described by SEQ ID NOS: 2, 4, 6, 8, 10, 12, 14, 16, 18, and 20.

Such a polynucleotide sequence may also encode modified FMDV 3C protease that contains insertions, substitutions, or deletions of other amino acid residues of a native 3C protease, or that retains native FMDV 3C protease residues. For example, a modified FMDV 3C protease may contain one or more, or all, of the proline or cysteine residues of a native FMDV 3C protease or may contain substitutions or deletions of one or more proline or cysteine residues of a native FMDV 3C protease. For example, the polynucleotide of the invention may encode a FMDV 3C protease that contains cysteine residues at positions 51 and 163 or that encodes a modified FMDV 3C protease comprising residues H46, D84 and C163 of a native FMDV 3C protease.

In most embodiments, a polynucleotide of the invention will encode a FMDV 3C protease variant, or functionally active portions of such a 3C protease, that exhibit proteolytic activity on a FMDV P1 precursor polypeptide or on other polypeptides containing FMDV 3C protease recognition sites. Such a polynucleotide will preferably encode a modified FMDV 3C protease that is less toxic to, less disruptive to protein expression, less growth inhibitory to, or which exhibits attenuated proteolytic activity against host cell proteins. However, in some embodiments, the variant FMDV 3C protease may have attenuated or no proteolytic activity against at least one or all of the FMDV 3C protease recognition sites in a FMDV P1 protein, but will exhibit other useful properties, such as antigenicity, immunogenicity, or an ability to modulate cleavage or processing of FMDV P1 precursor protein or other proteins recognized by a functionally active FMDV 3C protease.

A polynucleotide according to the invention may encode a FMDV 3C protease modified at or within residues 26-35 of a wild-type FMDV 3C protease where residues 26-35 of the wild-type protease comprise the amino acid sequence KTVA(I/L)CCATF (SEQ ID NO: 158, position 28 underlined). One, two, three or more residues within this section of the wild-type FMDV 3C protease may be modified by substitution, deletion or insertion. One example of such a variant is the V28K mutant of the FMDV 3C protease. Polynucleotides encoding a variant containing the V28K substitution include those selected from the group of polynucleotide sequences described by SEQ ID NO: 41, 43, 45, 47, 49, 51, 53, 55, 57, and 59 or selected from the group of polynucleotides encoding the amino acid sequences of SEQ ID NO: 42, 44, 46, 48, 50, 52, 54, 56, 58 or 60.

A polynucleotide according to the invention may encode a FMDV 3C protease modified at or within residues 125-134 of a wild-type FMDV 3C protease where residues 125-134 of the wild-type protease comprise the amino acid sequence GRLIFSG(D/E)AL (SEQ ID NO: 156, position 127 underlined). One, two, three or more residues within this section of the wild-type FMDV 3C protease may be modified by substitution, deletion or insertion. One example of such a variant is the L127P mutant of the FMDV 3C protease. Polynucleotides encoding a variant containing the L127P substitution include those selected from the group of polynucleotide sequences described by SEQ ID NO: 21, 23, 25, 27, 29, 31, 33, 35, 37, and 39 or selected from the group of polynucleotides encoding the amino acid sequences of SEQ ID NO: 22, 24, 26, 28, 30, 32, 34, 36, 38 and 40.

A polynucleotide according to the invention may encode a FMDV 3C protease modified at or within residues 138-150 of a wild-type FMDV 3C protease where residues 138-150 of the wild-type protease comprise the amino acid sequence D(I/L)VVCMDGDTMPF (SEQ ID NO: 157, positions 141 and 142 underlined). One, two, three or more residues within this section of the wild-type FMDV 3C protease may be modified by substitution, deletion or insertion. Examples of such variants are the V141T and C142T mutants of the FMDV 3C protease. Polynucleotides encoding a mutant containing the V141T substitution include those selected from the group of polynucleotide sequences described by SEQ ID NO: 61, 63, 65, 67, 69, 71, 73, 75, 77, and 79 or selected from the group of polynucleotides encoding the amino acid sequences of SEQ ID NO: 62, 64, 66, 68, 70, 72, 74, 76, 78 and 80; and polynucleotides encoding the C142T mutant (which also contain the L127P substitution) include those selected from the group of polynucleotide sequences described by SEQ ID NO: 81, 83, 85, 87, 89, 91, 93, 95, 97, and 99 or selected from the group of polynucleotides encoding the amino acid sequences of SEQ ID NO: 82, 84, 86, 88, 90, 92, 94, 96, 98 and 100.

A polynucleotide according to the invention may be a chimeric polynucleotide comprising a sequence encoding a modified or mutant FMDV 3C protease and a sequence encoding a FMDV P1 protein or other protein containing cleavage sites recognized by the FMDV 3C protease, such as a non-naturally-occurring precursor polypeptide comprising FMDV viral proteins or other fused proteins separated by FMDV 3C protease cleavage sites. This is advantageous because a single polynucleotide molecule will encode both the modified FMDV 3C protease and its substrate facilitating transformation or transfection of a host cell and controlling the relative numbers of copies of each coding sequence on the single chimeric polynucleotide. A single chimeric polynucleotide can encode a modified FMDV 3C protease comprising one or more amino acid substitutions within residues 26-35, 125-134, or 138-150 of a wild-type FMDV 3C protease, such as a mutant FMDV 3C protease comprising one or more amino acid substitutions at positions 28, 127, 141 or 142 of a native 3C protease (e.g., L127P, V141T, and/or C142T), and further encode at least one FMDV P1 precursor polypeptide or other polypeptide substrate for the modified FMDV 3C protease.

Preferably, such a chimeric polynucleotide when transformed into and co-expressed in a host cell will (i) enhance transgene expression of the FMDV P1 precursor polypeptide (or other precursor substrate polypeptide) compared to an otherwise identical polynucleotide that encodes a FMDV 3C protease not comprising the one or more amino acid substitutions within residues 26-35, 125-134, or 138-150; (ii) increase an amount of FMDV VP0, VP1, VP2, VP3 and/or VP4 (or cleavage products of another substrate precursor polypeptide) produced by the host cell compared to an otherwise identical polynucleotide that encodes a FMDV 3C protease not comprising said the one or more amino acid substitutions within residues 26-35, 125-134, or 138-150; (iii) increase the amount of eIF4AI translation factor in the host cell or decrease the amount of proteolytically-cleaved eIF4AI in the host cell compared to an otherwise identical polynucleotide that encodes a FMDV 3C protease not comprising said the one or more amino acid substitutions within residues 26-35, 125-134, or 138-150; or (iv) increase the amount of histone H3, nuclear transcription factor kappa B essential modulator (NEMO), or Src-associated substrate in mitosis of 68 kDa (SAM68) in the host cell or decrease the amount of proteolytically-cleaved histone H3, nuclear transcription factor kappa B essential modulator (NEMO), or Src-associated substrate in mitosis of 68 kDa (SAM68) in the host cell compared to an otherwise identical polynucleotide that encodes a FMDV 3C protease not comprising said the one or more amino acid substitutions within residues 26-35, 125-134, or 138-150. Such polynucleotides may be designed, for example to adopt preferred codon usage of a particular host cell, and inserted into vectors or polynucleotide constructs suitable for expression in a particular host cell or expression system, including eukaryotic and prokaryotic host cells.

Another associated embodiment to the polynucleotide of the invention as described above is a vector or other polynucleotide construct, including plasmids, minicircle vectors and viral or phage vectors, transposons, as well as non-replicating (e.g. that do not contain an origin of replication), but transformable, polynucleotide constructs comprising a polynucleotide sequence according to the invention, which encode a modified FMDV 3C protease, or both a modified FMDV 3C protease and a FMDV P1 precursor protein or other engineered precursor protein comprising cleavage sites recognized by the modified FMDV 3C protease.

Such a vector will generally contain at least one polynucleotide sequence encoding a mutant or variant FMDV 3C protease. Preferably the vector (or a combination of two or more vectors) will further comprise at least one sequence encoding FMDV P1 precursor protein or other substrate precursor protein of interest comprising FMDV 3C recognition sites. Vectors comprising multiples of the FMDV 3C protease sequences or multiples of FMDV P1 protein sequences (or other precursor protein sequences) are also contemplated, such as vectors containing 2, 3, 4 or more of such sequences. In another embodiment, the polynucleotide encoding a modified FMDV 3C protease and the polynucleotide encoding the FMDV P1 precursor protein or other precursor protein recognized by the protease, may be placed on separate vectors suitable for co-transformation or co-transfection into a host cell.

The vector or polynucleotide construct of the invention may contain at least one polynucleotide sequence encoding a FMDV P1 precursor polypeptide from a FMDV O serotype, A serotype, C serotype, Asia 1 serotype, SAT1 serotype, SAT2 serotype or SAT3 serotype; at least one polynucleotide sequence encoding a FMDV P1 precursor polypeptide where the polynucleotide sequence is described by SEQ ID NO: 101, 103, 105, 107, 109, 111, 113, 115 or 117; or at least one polynucleotide sequence encoding a FMDV P1 precursor polypeptide that is at least 70, 75, 80, 85, 90, 95, 96, 97, 98, or 99% similar or identical to SEQ ID NO: 102, 104, 106, 108, 110, 112, 114, 116 or 118.

The vector or polynucleotide construct of the invention may further comprise at least one polynucleotide sequence encoding one or more of FMDV viral proteins VP0, VP3, VP1; or VP1, VP2, VP3 and/or VP4 in the same order that they are arranged in the FMDV P1 precursor protein or in a different order separated by cleavage sites recognized by the modified FMDV 3C protease.

The vector or polynucleotide construct of the invention may further comprise at least one promoter or other transcription regulatory element, at least one prokaryotic or eukaryotic translation initiation sequence or other translation regulatory element, at least one translational interrupter sequence, at least one reporter gene, or at least one selectable marker, such as an antibiotic resistance gene, operatively linked to the polynucleotide sequence encoding the modified FMDV 3C protease or other precursor protein of interest encoded the vector or polynucleotide construct. Other elements, such as a translation interrupter sequence such as 2A or Δ1D2A sequence may be incorporated into a vector or polynucleotide construct at places where protein cleavage is desired, such as before or after a tag, marker or indicator protein such as GLuc and/or SGLuc.

A vector or polynucleotide construct may be selected based on its capacity to be expressed by a particular host cell or expression system, such as in a eukaryotic or prokaryotic cell. Examples of such vectors include those that can be transformed into and expressed by *Saccharomyces cerevisiae, Pichia pastoris*, or another yeast or fungus cell; *Arabidopsis thaliana, Chlamydomonas reinhardtii*, by *Glycine max, Nicotiana benthamiana, Nicotiana tabacum, Oryza sativa, Zea mays* or another plant cell; by *Spodoptera frugiperda, Drosophila melanogaster*, Sf9, Sf21, or another insect cell; by a vertebrate cell; by HEK-293-T (human kidney embryo) cell, LF-BK (porcine cell), LF-BK αV/β6 cell, or by another mammalian cell; by a host cell derived from a mammal or other animal susceptible to FMDV infection. Alternatively, the vector, including phage vectors, may be selected to transform or transfect into and be expressed by a prokaryotic cell including *Bacillus, Lactococcus, Streptomyces, Rhodococcus, Corynebacterium, Mycobacterium* or in another gram-positive prokaryote; or *Escherichia, Pseudomonas* or another gram-negative prokaryote.

A vector or construct may constitute a minicircle vector, a replication deficient adenovirus vector, a vaccinia virus vector, or other viral vector that expresses the modified FMDV 3C protease and, optionally, a FMDV P1 precursor polypeptide or other precursor protein of interest in a host cell. Such host cells include those directly obtained from an organism, including immunocytes, such as lymphocytes or macrophages, stem cells or muscle cells, as well as cell lines passaged in vitro derived from such cells.

Another aspect of the invention compatible with the polynucleotides and vectors/polynucleotide constructs of the invention as disclosed above is a host cell that can be transformed or transfected with a polynucleotide or vector according to the invention and used to express the modified FMDV 3C protease and other polypeptides of interest, such as FMDV P1 precursor protein. Such a host cell may be transformed or transfected to express only the modified FMDV 3C protease or may be co-transformed or co-transfected with vectors or polynucleotide constructs expressing both the modified 3C protease the FMDV P1 precursor protein or other cleavable protein of interest.

The host cell of the invention may contain a vector or polynucleotide construct further comprising at least one promoter or other transcription regulatory element, at least one prokaryotic or eukaryotic translation initiation sequence or other translation regulatory element, at least one translational interrupter sequence, at least one reporter gene, or at least one selectable marker, such as an antibiotic resistance gene, operatively linked to the polynucleotide sequence encoding the modified FMDV 3C protease or another protein of interest encoded by polynucleotides in said vector.

The host cell of the invention may be transformed or transfected with a single vector or polynucleotide construct or with multiple vectors or multiple polynucleotide constructs, encoding the modified FMDV 3C protease and FMDV P1 precursor polypeptide or other cleavable polypeptide of interest that contains cleavage sites recognized by the modified FMDV 3C protease. The host cell may express a recombinant a fusion protein or chimeric protein comprising a FMDV P1 precursor polypeptide or one or more, or a set of FMDV viral protein(s) such as VP0, VP3, and VP1, or VP1, VP2, VP3 and VP4, a translation interrupter sequence such as 2A or Δ1D2A, a linker or spacer peptide, a His-tag or FLAG-tag or other protein tag, a reporter protein, or a luminescent sequence such as GLuc and/or SGLuc. A host cell according to the invention may express FMDV proteins from various serotypes, such as a FMDV P1 precursor polypeptide from a FMDV O serotype, A serotype, C serotype, Asia 1 serotype, SAT1 serotype, SAT2 serotype or SAT3 serotype or a FMDV P1 precursor polypeptide described by SEQ ID NO: 102, 104, 106, 108, 110, 112, 114, 116 or 118, or a FMDV P1 protease at least 70, 75, 80, 85, 90, 95, 96, 97, 98, or 99% similar or identical thereto.

The host cell of the invention may be obtained from or derived from a eukaryotic cell. Examples of such host cells include *Saccharomyces cerevisiae*, *Pichia pastoris*, or another yeast or fungus cell; *Arabidopsis thaliana*, *Chlamydomonas reinhardtii*, *Glycine max*, *Nicotiana benthamiana*, *Nicotiana tabacum*, *Oryza sativa*, *Zea mays* or another plant cell; *Spodoptera frugiperda*, *Drosophila melanogaster*, Sf9, Sf21, or another insect cell; a vertebrate cell; HEK-293-T (human kidney embryo) cell, LF-BK (porcine cell), LF-BK αV/β6 cell, or another mammalian cell; by a host cell derived from a mammal or other animal susceptible to FMDV infection.

Alternatively, a host cell may be a prokaryotic cell such as *Bacillus*, *Lactococcus*, *Streptomyces*, *Rhodococcus*, *Corynebacterium*, *Mycobacterium* or another gram-positive prokaryote; or *Escherichia*, *Pseudomonas* or another gram-negative prokaryote.

The host cell may be one suitable for transformation by the vectors and polynucleotide constructs disclosed herein or by a minicircle vector, a replication deficient adenovirus vector, a vaccinia virus vector, or other viral vector that expresses the modified FMDV 3C protease and, optionally, a FMDV P1 precursor polypeptide or other protein of interest besides the modified FMDV 3C protease in a host cell. Such host cells include those directly obtain from an organism, including stem cells, epithelial cells, or muscle cells, as well as cells passaged in vitro derived from such cells.

A host cell of the invention may contain a vector or polynucleotide construct that encodes the recombinant FMDV P1 precursor polypeptide which will be expressed by the host cell and cleaved by the recombinant FMDV 3C protease also expressed by the host cell. It may contain a vector or construct encoding a modified foot-and-mouth disease (FMDV) 3C protease as disclosed herein which comprises one or more amino acid substitutions within residues 26-35, 125-134, or 138-150 of a FMDV 3C protease, and at least one polynucleotide sequence that encodes an FMDV P1 precursor polypeptide, wherein said host cell expresses a higher amount of FMDV P1 precursor polypeptide than an otherwise identical host cell containing a vector or polynucleotide construct that encodes a FMDV 3C protease not comprising said the one or more amino acid substitutions within residues 26-35, 125-134, or 138-150; or a host cell that expresses more VP0, VP3, or VP1 (or VP2, VP4, VP3 and VP1) than an otherwise identical host cell containing a vector or polynucleotide construct that encodes a FMDV 3C protease not comprising the one or more amino acid substitutions within residues 26-35, 125-134, or 138-150; or a host cell that produces more FMDV VLPs than an otherwise identical host cell containing a vector or polynucleotide construct that encodes a FMDV 3C protease not comprising said the one or more amino acid substitutions within residues 26-35, 125-134, or 138-150. For example, a host cell of the invention may produce 1.05, 1.1, 1.25, 1.5, 1.75, 2, 3, 4, 5, 6, 7, 8, 9, 10, 15, 20 or more times FMDV P1 precursor protein, VP0, VP1, VP2, VP3, VP4, or VLPs that an otherwise identical host cell expressing a corresponding not mutated FMDV 3C protease.

A host cell according to the invention may contain a vector or polynucleotide construct encoding a modified foot-and-mouth disease (FMDV) 3C protease comprising one or more amino acid substitutions within residues 26-35, 125-134, or 138-150, and at least one polynucleotide sequence that encodes an FMDV P1 precursor polypeptide, wherein said host cell expresses or contains (i) a higher amount of eIF4AI translation factor, histone H3, nuclear transcription factor kappa B essential modulator (NEMO), or Src-associated substrate in mitosis of 68 kDa (SAM68) or (ii) produces or contains a decreased amount of proteolysed eIF4AI, histone H3, nuclear transcription factor kappa B essential modulator (NEMO), or Src-associated substrate in mitosis of 68 kDa (SAM68) compared to the amounts expressed or present in an otherwise identical host cell containing a vector or polynucleotide construct that encodes a FMDV 3C protease not comprising the one or more amino acid substitutions within residues 26-35, 125-134, or 138-150.

A host cell according to the invention may also contain a vector or polynucleotide construct encoding a modified foot-and-mouth disease (FMDV) 3C protease comprising one or more amino acid substitutions within residues 26-35, 125-134, or 138-150, and at least one other vector or polynucleotide construct encoding an FMDV P1 precursor polypeptide or other polypeptide of interest besides the FMDV 3C protease. Host cells which express a modified foot-and-mouth disease (FMDV) 3C protease and/or an FMDV P1 precursor polypeptide or other polypeptide of interest from their chromosomal DNA are also contemplated. For example, a host cell may express a modified FMDV 3C protease from its chromosomal DNA and express a FMDV P1 precursor from vector DNA, or vice versa.

Another aspect of the invention constitutes a method for expressing and/or processing FMDV P1 precursor polypeptide (or other precursor polypeptide of interest) into FMDV viral proteins (or smaller proteins of interest) comprising culturing a host cell according to the invention in a suitable medium and recovering viral proteins VP0, VP1, VP2, VP3 or VP4 or FMDV virus-like particles or other cleavage products of a protein or polypeptide of interest; wherein said host cell expresses a modified FMDV 3C protease, which contains one or more amino acid substitutions within residues 26-35, 125-134 or 138-150 of a native FMDV 3C protease, and said host cell also expresses an FMDV P1 precursor polypeptide. Such a method may be employed to produce one or more or a set of FMDV viral proteins or VLPs. For example, it may be used to produce and recover VP0, VP1 and VP3 or VP1, VP2, VP3 and VP4. Such a method may result in the cleavage by the modified 3C protease of at least 10, 20, 30, 40, 50, 60, 70, 80, 90 or 100% of the FMDV P1 precursor polypeptide or other precursor polypeptide of interest expressed by a host cell according to the invention.

In another embodiment, the method according to the invention may cleave less of one or more host cell proteins which are cleaved by a corresponding unmodified FMDV 3C protease which does not contain one or more amino acid substitutions within residues 26-35, 125-134 or 138-150 of a corresponding unmodified FMDV 3C protease amino acid sequence. For example, the method according to the invention using a modified 3C protease may cleave less than 10, 20, 30, 40 or 50% of one or more host cell proteins than an otherwise identical method using the corresponding unmodified FMDV 3C protease. Such host cell proteins include, but are not limited to, eIF4AI, histone H3, nuclear transcription factor kappa B essential modulator (NEMO), or Src-associated substrate in mitosis of 68 kDa (SAM68). Thus, host cells employed in a method according to the invention, which express a modified FMDV 3C protease, may contain (i) an increased amount of not proteolyzed eIF4AI, histone H3, nuclear transcription factor kappa B essential modulator (NEMO), or Src-associated substrate in mitosis of 68 kDa (SAM68) or (ii) a decreased amount of proteolysed eIF4AI, histone H3, nuclear transcription factor kappa B essential modulator (NEMO), or Src-associated substrate in mitosis of 68 kDa (SAM68) compared to host cells used in an otherwise identical method which uses host cells expressing an unmodified FMDV 3C protease, such as a 3C protease which does not contain one or more amino acid substitutions within residues 26-35, 125-134 or 138-150.

A method according to the invention may produce and/or allow recovery of more FMDV P1 precursor polypeptide, more of at least one kind of FMDV viral protein, such as VP0, VP1, VP2, VP3, or VP4, or more VLPs (or more non-P1 precursor polypeptides and their proteolytic or quaternary products) than an otherwise identical method using a host cell containing a corresponding unmodified FMDV 3C protease which does not contain one or more amino acid substitutions within residues 26-35, 125-134 or 138-150 of a wild-type FMDV 3C protease.

In some embodiments, a method according to the invention will comprising culturing a host cell containing a vector or polynucleotide construct containing a translation interrupter sequence, such as a 2A sequence, and optionally a protein that can be secreted from the cell, such as GLuc or SGLuc. A translation interrupter sequence permits interruption of protein translation and effective cleavage at a site not necessarily recognized by a 3C protease such as a site between a FMDV P1 protein and a reporter protein or luminescent protein, such as GLuc, SGLuc or other luciferase protein which, optionally, can be secreted. Interruption of translation by 2A produces a polypeptide not having an N-terminal Met residue.

This aspect of the invention includes embodiments where the vector or polynucleotide construct in the host cell encodes a modified 3C protease, a 2A or other translation interrupter sequence, and an FMDV P1 precursor polypeptide, and optionally at least one of GLuc, SGLuc or other luciferase which can be secreted; and embodiments where the host cell comprises a vector or polynucleotide construct expressing a fusion protein comprising a modified 3C protease and an FMDV P1 precursor polypeptide and at least one of GLuc, SGLuc or other luciferase which can be secreted, and optionally at least one of a 2A, Δ1D2A, or other translation interrupter sequence.

In these embodiments a 2A sequence will generally be arranged between segments of a fusion protein to be separated and produce a downstream (toward the C-terminal of the fusion protein) protein or protein fragment without an N-terminal Met residue. The N-terminal and C-terminal portions of such a fusion protein may contain a FMDV 3C protease segment, FMDV P1 precursor protein (or other precursor protein of interest) segment, and a GLuc or SGLuc segment in any order, including where the GLuc or SGLuc segments appear at the C-terminal or N-terminal of the fusion protein and are separated from the remainder of the fusion protein by a 2A-type translation interrupter site. Separation of a protein that can be secreted by the cell, such as GLuc or SGLuc, from a longer fusion protein molecule that also encodes the FMDV P1 precursor or other precursor polypeptide of interest, and/or the modified FMDV 3C protease, provides a convenient means to monitor recombinant protein expression by measuring levels of the secreted protein in an extracellular medium.

Another aspect of the invention constitutes a modified foot-and-mouth disease (FMDV) 3C protease comprising one or more amino acid substitutions within residues 26-35, 125-134 or 138-150 of a wild-type FMDV 3C protease. A modified foot-and-mouth disease (FMDV) 3C protease according to the invention may be, but is not limited to one, that is at least 70, 80, 90, 95, 96, 97, 98, 99% identical or similar to at least one wild-type protease from FMDV O serotype, A serotype, C serotype, Asia 1 serotype, SAT1 serotype, SAT2 serotype, or SAT3 serotype, to a 3C protease encoded by a polynucleotide sequence described by SEQ ID NO: 1, 3, 5, 7, 9, 11, 13, 15, 17, and 19, or to an amino acid sequence described by SEQ ID NO: 2, 4, 6, 8, 10, 12, 14, 16, 18, and 20. Such a modified protease may contain all or some of the cysteine or proline residues found in a native FMDV protease, such as cysteine residues forming disulfide bridges in a native FMDV 3C protease. In some embodiments it will contain cysteine residues at positions 51 and 163, residues H46, D84 and C163, or will not contain glutamic acid (E) at position 126 (R126E) or will not contain serine at position 133 (A133S), or have combinations of these retained or substituted residues.

In most embodiments, the modified FMDV 3C protease variant, or functionally active portions of such a protease will exhibit proteolytic activity on a FMDV P1 precursor polypeptide or on other polypeptides containing FMDV 3C protease recognition sites. A modified FMDV 3C protease is preferably less toxic to, less disruptive to protein expression, less growth inhibitory to, or exhibits attenuated proteolytic activity against host cell proteins compared to a corresponding unmodified FMDV 3C protease. However, in some embodiments, the variant FMDV 3C protease can have attenuated or no proteolytic activity against FMDV P1 protein, but exhibit other useful properties, such as immunogenicity, antigenicity or the ability to modulate cleavage or processing of FMDV P1 or other proteins recognized by native or other functionally active FMDV 3C proteases.

A FMDV 3C protease according to the invention may be modified at or within residues 26-35 of a wild-type FMDV 3C protease where residues 26-35 of the wild-type protease comprise the amino acid sequence KTVA(I/L)CCATF (SEQ ID NO: 158, position 28 underlined). One, two, three or more residues within this section of the wild-type FMDV 3C protease may be modified by substitution, deletion or insertion. One example of such a variant is the V28K mutant of the FMDV 3C protease. Variants containing the V28K substitution include those encoded by the polynucleotide sequences described by SEQ ID NO: 41, 43, 45, 47, 49, 51, 53, 55, 57, and 59 or those comprising the amino acid sequences of SEQ ID NO: 42, 44, 46, 48, 50, 52, 54, 56, 58 or 60.

A FMDV 3C protease according to the invention may be modified at or within residues 125-134 of a wild-type FMDV 3C protease where residues 125-134 of the wild-type protease comprise the amino acid sequence GR LIFSG(D/E)AL (SEQ ID NO: 156, position 127 underlined). One, two, three or more residues within this section of the wild-type FMDV 3C protease may be modified by substitution, deletion or insertion. One example of such a variant is the L127P mutant of the FMDV 3C protease. Variants containing the L127P substitution include those encoded by the polynucleotide sequences described by SEQ ID NO: 21, 23, 25, 27, 29, 31, 33, 35, 37, and 39 or those comprising the amino acid sequences of SEQ ID NO: 22, 24, 26, 28, 30, 32, 34, 36, 38 and 40.

A FMDV 3C protease according to the invention may be modified at or within residues 138-150 of a wild-type FMDV 3C protease where residues 138-150 of the wild-type protease comprise the amino acid sequence D(I/L)V VCMDGDTMPF (SEQ ID NO: 157, positions 141 and 142 underlined). One, two, three or more residues within this section of the wild-type FMDV 3C protease may be modified by substitution, deletion or insertion. Examples of such variants are the V141T and C142T mutants of the FMDV 3C protease.

A variant containing the V141T substitution may be encoded by a polynucleotide sequence described by SEQ ID NO: 61, 63, 65, 67, 69, 71, 73, 75, 77, and 79 or comprise an amino acid sequence of SEQ ID NO: 62, 64, 66, 68, 70, 72, 74, 76, 78 and 80.

A variant containing the C142T substitution (which also contains the L127P substitution) may be encoded by a polynucleotide sequence described by SEQ ID NO: 81, 83, 85, 87, 89, 91, 93, 95, 97, and 99 or comprise an amino acid sequence of SEQ ID NO: 82, 84, 86, 88, 90, 92, 94, 96, 98 and 100.

Another aspect of the invention is a composition comprising a modified FMDV 3C protease and a pharmaceutically acceptable excipient or adjuvant, or a buffer or solution suitable for performing proteolysis using a modified FMDV 3C protease. Such a composition may be used to induce or detect immune responses against the 3C protease, such as humoral (e.g., antibody) or cellular immune responses (e.g., T-cell responses) directed against the 3C protease. Such a composition may further contain precursor polypeptides, such as FMDV P1 precursor, that contain sites recognized by the modified FMDV 3C protease and be in a form useful for processing precursor polypeptides in vitro.

Another aspect of the invention represents a FMDV P1 precursor polypeptide, P1 polypeptide, VP0, VP1, VP2, VP3 or VP4 protein or FMDV virus-like particle produced by a host cell or method described herein. Such a FMDV P1 precursor polypeptide, P1 polypeptide, VP0, VP1, VP2, VP3 or VP4 protein or FMDV virus-like particle may be produced by a prokaryotic or a eukaryotic expression system and have features characteristics of those expression systems, such as the absence of glycosylation when expressed by a prokaryote, or the presence of glycosylation or other post-translation modifications provided during eukaryotic expression.

Another aspect of the invention is an antigen, immunogen or vaccine comprising the FMDV P1 precursor polypeptide, P1 polypeptide, VP0, VP1, VP2, VP3 or VP4 protein or FMDV virus-like particles produced using the modified FMDV 3C protease disclosed herein in combination with a suitable carrier, excipient or adjuvant. Such products are useful for detecting immune responses against FMDV, such as FMDV-specific antibodies or FMDV-specific T-cells. Such antigens, immunogens or vaccines also may be used to induce an immune response against FMDV, vaccinate a subject against FMDV, or reduce the severity of an FMDV infection by administering them to a subject in need thereof such as a subject infected with or at risk of infection by FMDV. A FMDV P1 precursor polypeptide, P1 polypeptide, VP0, VP1, VP2, VP3 or VP4 protein or FMDV virus-like particle produced by a method according to the invention may be administered to a subject in need thereof.

Alternatively, a composition comprising a vector or polynucleotide construct encoding a modified FMDV 3C protease polypeptide and a P1 precursor protein may be administered to a subject in need thereof, for example, into muscle tissue of an animal susceptible to FMDV infection, where the P1 precursor polypeptide can be expressed and proteolytically processed in vivo by the co-expressed modified FMDV 3C protease.

Another aspect of the invention involves chimeric polynucleotides encoding fusion proteins comprising FMDV segments and translation termination interrupters, such as 2A-like sequences, and reporter proteins such as GLuc or SGLuc and the encoded fusion proteins per se. Such a polynucleotide may encode a fusion protein comprising at least one of (i) a 2A, Δ1D2A, or other translation interrupter sequence, and at least one GLuc, SGLuc or other luciferase which can be secreted and/or at least one enzyme or other polypeptide of interest which can be secreted. Such a polynucleotide may encode at least one GLuc, SGLuc or other luciferase which can be secreted and/or at least one enzyme or other polypeptide of interest which can be secreted that does not have an N-terminal methionine residue by virtue of translation interruption by 2A or a 2A-like sequence. Examples of such chimeric polynucleotide constructs encoding fusion proteins include the polynucleotides having sequences described by SEQ ID NO: 147, 148, 149, 150, 151, or 152 and variant polynucleotides that have sequences that are at least 70, 80, 90, 95 or 99% identical or similar to the sequences described by SEQ ID NO: 147, 148, 149, 150, 151, or 152 and which retain the functionality of the FMDV, 2A or other translation interrupter, and GLuc, SGLuc or other reporter protein segments. Examples of fusion proteins include those encoded by SEQ ID NO: 147, 148, 149, 150, 151, or 152 or their polynucleotide variants, which are described by SEQ ID NO: 213, 214, 215, 216, 217 or 218 as well as variant amino acid sequences that are at least 70, 80, 90, 95 or 99% identical or similar to a sequence of SEQ ID NO: 213, 214, 215, 216, 217 or 218 and which retain the functionality of the FMDV, 2A or other translation interrupter, and GLuc, SGLuc or other reporter protein segments.

The polynucleotide according to this aspect of the invention may be incorporated into a vector or polynucleotide construct, such as the vectors or polynucleotide constructs described herein and such a vector or polynucleotide construct may be transformed into, or transfected into, a suitable host cells such as those disclosed herein A related aspect of the invention is a method for producing an enzyme or other polypeptide of interest that can be secreted from the cell, comprising culturing the host cell described above in suitable medium and recovering the enzyme or other polypeptide of interest outside of the cell. The protein that can be secreted may optionally lack an N-terminal Met residue, for example, by action of a 2A-like translation interrupter sequence.

Such a method may employ a host cell containing a vector or polynucleotide construct that encodes a fusion protein comprising (i) a protein of interest, (ii) at least one of a 2A, Δ1D2A, or other translation interrupter sequence, and/or (iii) at least one polypeptide that can be secreted from the cell selected from the group consisting of GLuc, SGLuc or other luciferase, at least one enzyme that can be secreted from the cell, and at least one other detectable polypeptide which can be secreted from the cell, and may further comprise monitoring expression of the protein of interest by measuring the amount of the at least one polypeptide that can be secreted from the cell outside the host cell. The secreted protein may lack an N-terminal Met residue depending on the relative location of a 2A interrupter sequence.

The protein of interest may be a modified FMDV 3C protease, a FMDV P1 precursor polypeptide, or some other polypeptide of interest and may be incorporated as an antigen, immunogen or vaccinogen into a composition further comprising at least one pharmaceutically acceptable carrier, adjuvant, or excipient. Such a composition may be used for immunizing a subject by administering it to a subject in need thereof. For example, when the protein of interest is an FMDV P1 polypeptide or FMDV viral protein or VLP, it may be compounded into a composition with suitable excipients or adjuvants and administered to a subject susceptible to FMDV infection.

Proteins of interest produced by this method may be used for detecting an antibody, immunocyte (e.g. lymphocyte, macrophage) or other agent that binds to or interacts with the enzyme or other polypeptide of interest that can be secreted by the cell by contacting a sample containing said antibody, immunocyte or other agent with the enzyme or other polypeptide of interest, which may be expressed so as to lack an N-terminal Met residue, and detecting or quantifying complex formation thereby detecting said antibody, immunocyte or other agent.

Another aspect of the invention is a method for producing a polypeptide of interest that does not have an N-terminal methionine residue comprising transforming a host cell with a vector encoding a 2A, Δ1D2A, or other translation interrupter sequence operably linked to a polynucleotide encoding the polypeptide of interest and recovering the polypeptide of interest without the N-terminal methionine residue. The protein of interest may be recovered from the cell or, when it is capable of being secreted, from an extracellular medium. The vector in said method may be one that further encodes at least one of GLuc, SGLuc or other luciferase, enzyme or polypeptide of interest that can be secreted by the cell.

Another aspect of the invention constitutes a method for producing an enzyme or other polypeptide of interest that can be secreted by the cell comprising transforming a host cell with a vector encoding said enzyme or other polypeptide of interest fused to at least one of a 2A, Δ1D2A, or other translation interrupter sequence. The enzyme or polypeptide of interest that can be secreted by the cell in said method may be selected to be GLuc or SGLuc.

Reference through the specification to "one embodiment" or "an embodiment" means that a particular feature, structure, or characteristic described in connection with an embodiment is included in at least one embodiment of the subject matter disclosed. Thus, the appearance of the phrases "in one embodiment" or "in an embodiment" in various places throughout the specification is not necessarily referring to the same embodiment. Further, the particular features, structures or characteristics may be combined in any suitable manner in one or more embodiments.

EXAMPLES

The examples below are intended to further illustrate various protocols, including protocols for preparing and characterizing mutant FMDV 3C proteases, transgene expression cassettes carrying the mutant FMDV 3C proteases, vectors carrying the transgene expression cassettes, host cells transformed with the vectors, virus-like particles assembled and formed inside the host cells, DNA constructs or chimeras fusing a *Gaussia* luciferase gene (GLuc) or a super-luminescent *Gaussia* luciferase (SGLuc) with a foot-and-mouth disease virus (FMDV) translational interrupter sequence and an FMDV virus-like particle or VLP-expressing construct, and a mechanism for enhancement for transgene output by mutant FMDV 3C proteases. These examples are not intended to limit the scope of the claims. While these examples are provided for explanatory purposes, these should not be considered the only examples. Additional examples will be apparent based on the teachings of the present disclosure.

Overview of Examples 1-15

In the following Examples 1-15, in order to examine the effect of the expression of wild-type and mutant FMDV 3C proteases on transgene output, a luminescence assay that utilizes a chimera (Gluc-3C) of *Gaussia princeps* luciferase (GLuc) and an FMDV 3C protease (3C) was developed to monitor and quantify the cytotoxic effect that FMDV 3C protease expression has on transfected mammalian cells and total transgene output of transfected cells expressing the FMDV 3C protease. GLuc (SEQ ID NO: 201) is a small, naturally secreted luciferase of 185 amino acids (encoded by SEQ ID NO: 145 or 200). GLuc has a higher intensity when compared to firefly or *Renilla* luciferases making it ideal for studies which may involve only a small amount of peptide. A mutation of amino acids 89 and 90 in GLuc produces a super luminescent GLuc variant known as SGLuc (SEQ ID NO: 203), encoded by SEQ ID NO: 146 or 202 useful for examination of low levels of protein expression. GLuc is stable at 37° C. for extended periods of time which allows for a buildup of active GLuc in cell culture media further enhancing detection thresholds. These properties make SGLuc suitable for examination of protein expression over time when using transfected cell cultures.

The GLuc-3C constructs in Examples 1-15 utilize a Δ1D2A translational interrupter sequence (SEQ ID NO: 119) derived from the FMDV 2A protein to allow for individual expression of both GLuc and 3C. The 2A translational interrupter sequence results in equimolar quantities of each peptide being produced from a single open reading frame. Efficiency of 2A mediated cleavage depends upon the sequence present with the most efficient cleavage sequences incorporating portions of the C-terminus of the FMDV 1D protein. Inclusion of an 11 amino acid portion of the C-terminus of 1D (Δ1D2A) to the N-terminus of 2A and a proline residue to the C-terminus of 2A, as shown in FIG. 4A, makes 2A mediated translational interruption efficiency insensitive to the sequence upstream allowing for any protein to be present without detriment to 2A activity. The usage of the Δ1D2A sequence in chimeric constructs allows the total transgene output in response to FMDV 3C protease expression to be monitored, by measuring for the presence of luciferase activity in cell culture media, as shown in FIG. 4B.

Examples 1-15 show that the five different FMDV 3C protease single mutations (V28K, L127P, V141T, C142T and C163A) have diverse effects on total transgene output. The effect on transgene output was consistent regardless of whether or not the FMDV P1 polypeptide precursor was present in the construct. The sole exception was the inversion of the C163A and L127P samples in all luciferase assays conducted to monitor total transgene output. This inversion suggests that the presence of a large amount of unprocessed P1 polypeptide precursor may have a detrimental effect on transgene output. It should be noted however that any detrimental effect that the unprocessed P1 may have is minor when compared to the detrimental effect of expressing the wild-type FMDV 3C protease.

The C163A mutation is a knock-out mutation that removes all proteolytic activity of the FMDV 3C protease. The C142T mutation has been previously used in conjunction with an HIV-ribosomal frameshift sequence to down regulate overall 3C expression.

All mutations except C163A showed varying capabilities of processing of the P1 polypeptide precursor. With L127P, which is a mutation/amino acid substitution to the $B_2$ β-strand and is a surface residue having no proximity to the substrate binding cleft and the active site of the protease, the present inventors have surprisingly found that the mutant FMDV 3C protease is retaining the ability to fully process the P1 polypeptide while dramatically enhancing transgene output (i.e. not toxic to the host cells).

The combination of the L127P and C142T mutations produced a construct that was able to further enhance transgene output from the L127P and C142T single mutants and approximately 25× higher than the wild-type. The L127P/C142T double mutant produced an abundance of VLP crystalline arrays when HEK293-T transfected with the double mutant construct was examined with transmission electron microscopy (TEM).

Example 1: Insertion of GLuc into pTarget

Template DNA for GLuc was PCR amplified using One-Taq 2× Master Mix with Standard Buffer (New England Biolabs) and primers AscI-Kzk-Gluc-F (SEQ ID NO: 182) and Gluc-NS-NheI-R (SEQ ID NO: 181) per manufacturer's instructions. Insertion into the pTarget vector (Promega) followed manufacturer's instructions for T/A cloning. Transformants were plated on LB Agar plates with 100 ug/ml carbenicillin (Teknova). To confirm mutation-free insertion, the plasmids were sequenced using primers T7 (SEQ ID NO: 179) and Seq-R (SEQ ID NO: 180). Sequencing data was analyzed using the Sequencher 4.8 program (Genecodes).

Example 2: Construction of pTarget-GLuc-Δ1D2A

The Δ1D2A translational interrupter sequence used was derived from the FMDV A24 serotype sequence and flanked by NheI and XmaI restriction sites. Restriction digestions were performed on both the pTarget-GLuc vector and the Δ1D2A translational interrupter sequence using XmaI and NheI-HF restriction enzymes (New England Biolabs) per manufacturer's instructions. Both vector and insert were purified using a PCR purification kit (Qiagen). Ligation of the Δ1D2A sequence into the cut pTarget-GLuc vector was performed using T4 DNA ligase (Roche) as per manufacturer's instructions. Ligation reaction mix was cloned into NEB 5-alpha Competent *E. coli* (New England Biolabs) as per manufacturer's instructions. Sequencing was performed to confirm insertion as described previously in Example 1.

Example 3: Construction of pTarget-Gluc-Δ1D2A-3C

Amplification of 3C nucleic acids from an FMDV Asia Lebanon 89 (Accession #AY593798, SEQ ID NO: 1) non-infectious template was performed using OneTaq 2× Master Mix with Standard Buffer (New England Biolabs) as per manufacturer's instructions and using primers XmaI-3C-F (SEQ ID NO: 183) and 3C-NotI-R (SEQ ID NO: 174). PCR product was purified using a PCR purification kit (Qiagen). Both the 3C PCR product and pTarget Gluc-Δ1D2A vector were digested with XmaI and NotI-HF restriction enzymes (New England Biolabs) as per manufacturer's instructions. Ligation and cloning were performed as described in Example 2. Sequencing was performed as described in Example 1.

Example 4: Production of Mutant Nucleotide Sequences Encoding Mutant FMDV 3C Proteases The L127P Asia Lebanon 89 mutant nucleotide sequence (SEQ ID NO: 21) was created through random error during PCR amplification of 3C and identified during the sequencing process.

The V28K Asia Lebanon 89 (SEQ ID NO: 41), V141T Asia Lebanon 89 (SEQ ID NO: 61), and C163A Asia Lebanon 89 (SEQ ID NO: 209) mutant nucleotide sequences were created by using the GENEART® Site-Directed Mutagenesis System (Invitrogen) with the following primer sets:

3CLeb89 V28K-MF (SEQ ID NO: 163) and 3CLeb89 V28K-MR (SEQ ID NO: 164),

3CLeb89 V141T-MF (SEQ ID NO: 165) and 3CLeb89 V141T-MR (SEQ ID NO: 166),

3C C142T-MF (SEQ ID NO: 167) and 3C C142T-MR (SEQ ID NO: 168), or

3C C163A-MF (SEQ ID NO: 169) and 3C C163A-MR (SEQ ID NO: 170) for respective mutations.

The L127P Asia Lebanon 89 mutant nucleotide sequence (SEQ ID NO: 21) could also be alternatively constructed using primers 3C L127P-MF (SEQ ID NO: 171) and 3C L127P-MR (SEQ ID NO: 172) with the GENEART® Site-Directed Mutagenesis System.

Creation of the L127P/C142T Asia Lebanon 89 double mutant nucleotide sequence (SEQ ID NO: 81) was performed using the GENEART® Site-Directed Mutagenesis System on the previously constructed mpTarget O1P1-3C (C142T)-SGLuc construct as a template and using the 3C L127P-MF (SEQ ID NO: 171) and 3C L127P-MR (SEQ ID NO:172) primers.

Figure 5:
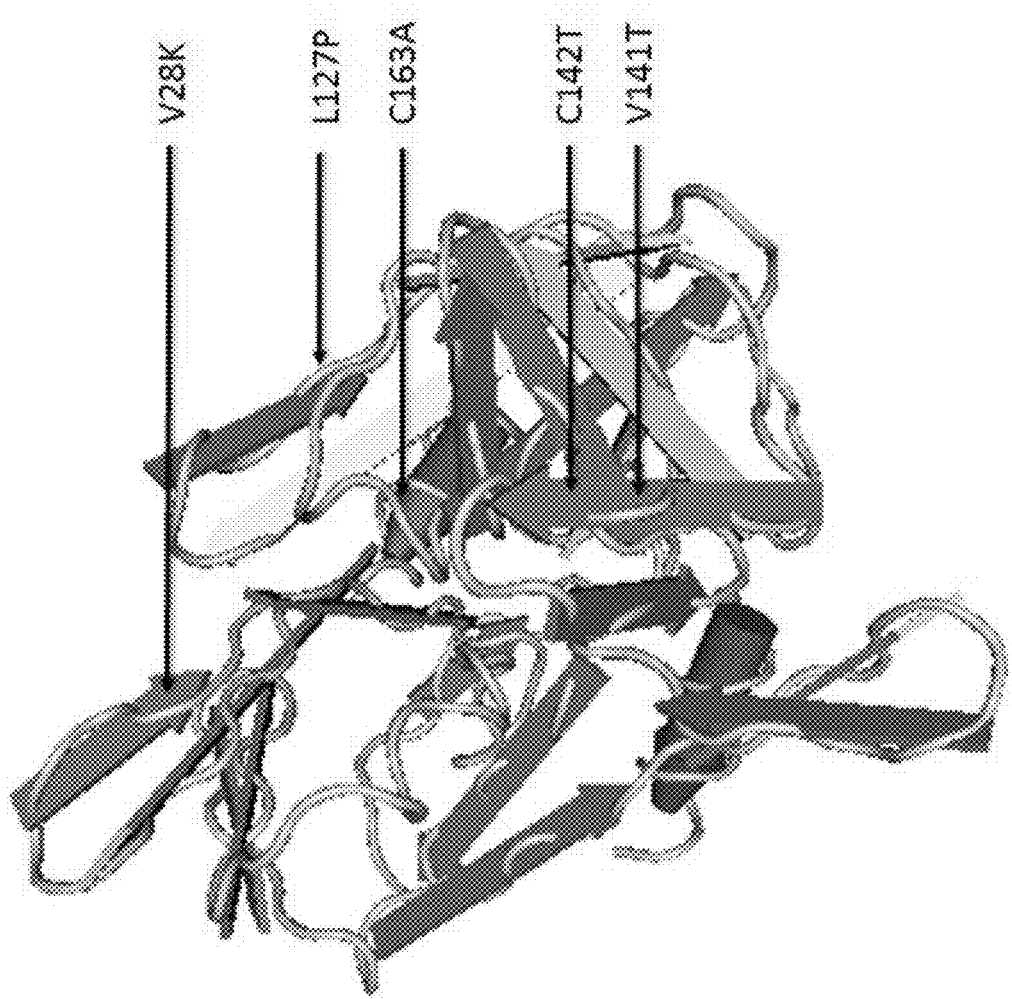
FIG. 5 shows the positions of residues substituted by the inventors to produce modified FMDV 3C proteases. These include V28K, L127P, V141T, C142T and C163A. Residue C163 is one residue of the catalytic triad and its substitution removes 3C protease activity. An example of such a C163A mutant is described by SEQ ID NOS: 209-210. These positions are shown on a ribbon diagram of the FMDV 3C protease crystal structure described by Protein Database identification 2j92, FMDV 3CP$^{pro}$ strain A10$_{61}$ which is incorporated by reference.

The locations of the FMDV 3C protease residues subjected to mutation and substitution, namely V28, L127, V141, C142 and C163 are indicated in the ribbon diagram of the protein of FIG. 5.

Site-directed mutagenesis PCR reactions were performed according to manufacturer's instructions with optional slight modifications as recognized as appropriate by a person of ordinary skill in the art. Each site-directed mutagenesis PCR reaction contains 45 µl of Accuprime Pfu Supermix (Life Technologies), 5 µl of 10× enhancer (Invitrogen), 1 µl of DNA methylase (Invitrogen), 0.25 µl of 200× S-adenosine methionine SAM (Invitrogen), 0.1 µl of pTarget Gluc-Δ1D2A-3C and 250 ng of each primer. The mutagenesis PCR reactions were carried out using the following parameters: 37° C. for 20 min; 94° C. for 2 min; then 35-40 cycles of (94° C. for 20 s, 57° C. for 30 s, 68° C. for 3 min and 30 s); and 68° C. 5 min. The recombination reaction and $E.\ coli$ transformations were performed as suggested by the manufacturer. Sequencing was performed as previously described.

Example 5: Transfection

HEK293-T cells (passage 41) were grown on Costar 6 Well Clear TC-Treated Multiple well plates (Corning Incorporated) in 293 growth media (1× minimum essential media or MEM media, 10% fetal bovine serum, 1% 100× GLutaMax™ media supplement, 1% MEM-NEAA (Non-essential amino acids), and 1% Antibiotic-antimycotic solution). Cells were rinsed with 2 ml of 1× Dulbecco's phosphate-buffer saline or DPBS (Gibco) and 2 mL of fresh media added to each well at roughly 80% confluence. Transfections were performed using 4 µg of plasmid DNA (pTarget Gluc-Δ1D2A-3C construct) and 10 µl of Lipofectamine 2000 per manufacturer's instructions. Transfected cells were placed in a 37° C. $CO_2$ incubator for 24 h.

Example 6: Luciferase Assay

After the incubation media was removed from each well containing a transfection reaction, the luciferase activity of each well was measured using a 96-well BioSystems Veritas luminometer (Turner Biosystems) with 20 µl of sample in each well. Readings were taken immediately upon injection of 25 µl of 50 µg/µl coelenterazine solution (NanoLight Technologies, Pinetop Ariz.) using an integration time of 0.5 s both before and after injection of substrate. Pre-injection readings were used to establish a baseline of light emission at the time of injection and subtracted from the post-injection values for data analysis. Replicates were averaged together to give the overall luciferase reading in relative light units per half second (RLU/0.5 s). A total of seven replicates were used for each sample.

Example 7: Construction of O1P1-3C-SGLuc Expression Constructs

The O1P1-3C-SGLuc constructs were prepared using a modified pTarget (mpTarget) vector. Modifications included decreasing overall vector size as well as removal of the multiple cloning site 5' EcoRI cut site. The P1 polypeptide sequence was derived from FMDV O1 Manisa serotype and was synthesized by Genscript and inserted into the mpTarget vector following digestion of both the synthesized sequence and the mpTarget vector with MluI and NotI-HF restriction enzymes (New England Biolabs) as per manufacturer's instructions. Ligation, cloning and sequencing was performed as previously described herein.

Amplification of 3C from an FMDV Asia Lebanon 89 (Accession #AY593798, SEQ ID NO: 1) non-infectious template was performed using OneTaq 2× Master Mix with Standard Buffer (New England Biolabs) as per manufacturer's instructions and using primers NotI-3CLeb89-F (SEQ ID NO: 173) and 3Casia-ns-EcoRI-R (SEQ ID NO: 184). The PCR product was purified using a PCR purification kit (Qiagen). Both PCR product and mpTarget O1P1 plasmid were digested with NotI-HF and EcoRI-HF restriction enzymes (New England Biolabs) as per manufacturer's instructions. Ligation, cloning and sequencing was performed as previously described.

Sequence for Δ1D2A-SGLuc was commercially synthesized (Genscript). Both synthesized sequence and the mpTarget O1P1-3C vector were digested with restriction enzymes EcoRI-HF and XmaI (New England Biolabs) as per manufacturer's instructions. Ligation, cloning and sequencing was performed as described herein.

The nucleotide sequences of the O1P1-3C-SGLuc constructs are given by the sequence identifier following each named construct: O1P1-3C(wt)-SGLuc (SEQ ID NO: 129), O1P1-3C(V28K)-SGLuc (SEQ ID NO: 130), O1P1-3C (L127P)-SGLuc (SEQ ID NO: 131), O1P1-3C(V141T)-SGLuc (SEQ ID NO: 132), O1P1-3C(C142T)-SGLuc (SEQ ID NO: 133) and O1P1-3C(C163A)-SGLuc (SEQ ID NO: 134).

Example 8: Transformation and Harvesting of Cells Transfected with O1P1-3C-SGLuc Constructs The transformation of HEK293-T cells with the prepared O1P1-3C-SGLuc constructs was performed as previously described herein. The incubation media was removed and assayed for luciferase activity as previously described herein. Cells were removed from surface by repeated pipetting of media then collected in a 15 ml conical tube (Falcon) and centrifuged at 500 rpm for 5 min to pellet cells. Cells were then re-suspended in 200 µl of MPER mammalian protein extraction reagent (Invitrogen). Samples were mixed with 4× NuPAGE loading buffer (Invitrogen) per manufacturer's instructions and heated at 95° C. for 10 min. Samples were then briefly centrifuged and loaded onto NuPAGE Novex 4-12% Bis-Tris protein gels (Invitrogen) and run in 1×MES (2-(N-morpholino)ethanesulfonic acid) buffer at 200 V for 35 min. The harvested, transformed cells were transferred to 0.2 µm pore size PVDF pre-cut blotting membranes (Invitrogen) with 1× transfer buffer (Invitrogen) per manufacturer's instructions.

Example 9: Western Blotting

Western blots were performed to examine for processed viral proteins VP1-VP4. Three antibodies were used: (1) the F14 (Anti-VP0 and VP2) mouse monoclonal at 1:50 dilution, (2) the 12FE9 (Anti-VP1) mouse monoclonal at 1:50 dilution, (3) an Anti-VP3 rabbit polyclonal at 1:250 dilution. All blots were performed with a one hour blocking step using 5% milk followed by three five minute washes with 1×PBS-T (phosphate buffered saline with Tween 20) buffer. Primary antibodies were applied for one hour at room temperature then removed and membranes washed three times for five minutes with 1×PBS-T buffer. Secondary antibodies using either Goat Anti-mouse-HRP (KPL) or Goat anti-rabbit-HRP (KPL) at 1:500 dilutions were applied to membranes for one hour at room temperature followed by three five-minute washes with 1×PBS-T. Visualization was performed using SIGMAFAST 3,3'-Diaminobenzidine tablets (Sigma) as per manufacturer's instructions for one hour at room temperature followed by two washes with double distilled water.

Example 10: Transmission Electron Microscopy (TEM)

Cells were grown in T-75 flasks for TEM. Cells were fixed in 2% glutaraldehyde in NaHCa (Heuser's) buffer, post-fixed with 1% tannic acid followed by 1% osmium tetroxide, en-bloc stained with 4% uranyl acetate, embedded in 2% agarose, dehydrated through graded series of acetone, and embedded in Spurr's resin (Electron Microscopy Sciences Hatfield, Pa., USA). Ultrathin (80 nm) sections were cut on a Leica UC6, stained with uranyl acetate and lead citrate, and imaged on a Hitachi 7600 with a 2 k×2 k AMT camera at 80 kV.

Example 11: Evaluation of Luciferase Activity of GLuc-3C Chimeras

Figure 6:
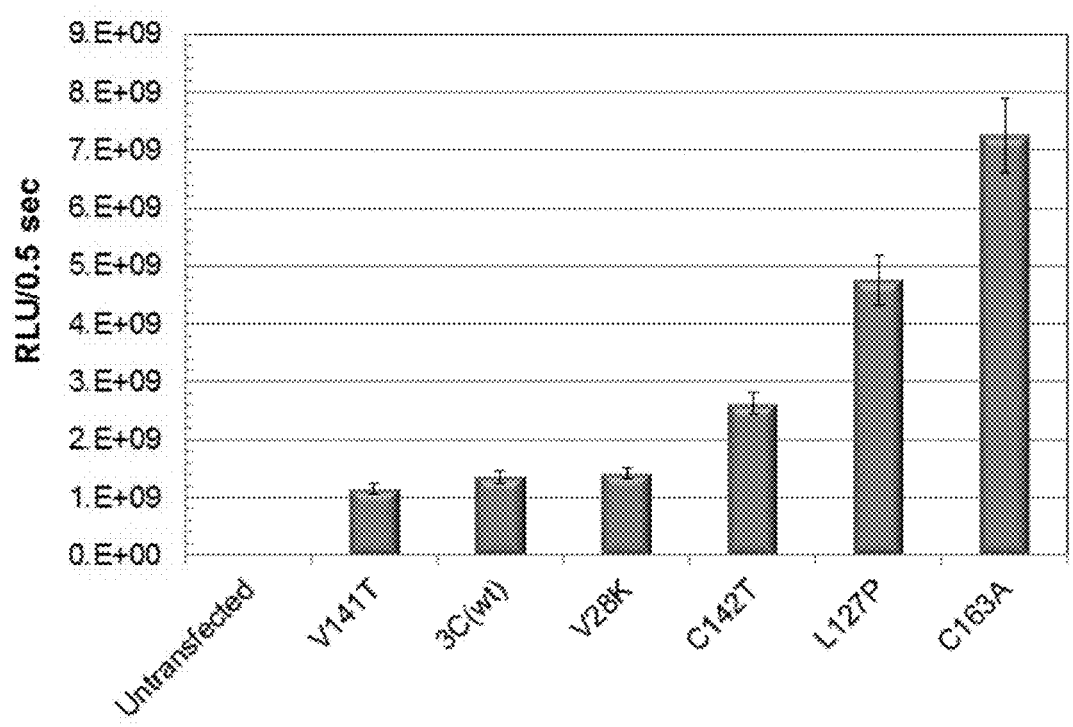
FIG. 6 compares luciferase activity of HEK293-T cells that have not been transfected (first bar), or have been transfected with vectors expressing GLuc-3C constructs (bars 2-7). The constructs depicted by bars 2-7 respectively contain the following substitutions to the 3C protease sequence of Asia Lebanon 89: V141T (bar 2), wild-type (bar 3, no substitution), V28K (bar 4), C142T (bar 5), L127P (bar 6), and C163A (bar 7) where the FMDV 3C was derived from FMDV serovar Asia Lebanon 89. Features of GLuc-3C constructs are depicted in FIG. 4B. Luciferase activity levels are represented in terms of relative light units (RLU) per unit of time (RLU/0.5 s.) Relatively high levels of luciferase activity were observed for constructs expressing 3C protease modified at C142T, L127P and C163A.

A total of six GLuc-3C chimeras were evaluated for their luciferase activities: C163A, C142T, V141T, L127P, V28K, and wild-type. Assay readings in FIG. 6 showed a diverse range outputs. The GLuc-3C chimera exhibiting the highest luciferase output was the total activity knockout mutant C163A while the lowest was the V141T mutation. As seen in FIG. 6, both the C142T and L127P mutations showed marked enhancement in luciferase outputs over the wild-type.

Example 12: O1P1-3C-SGLuc Chimeras

Figure 7:
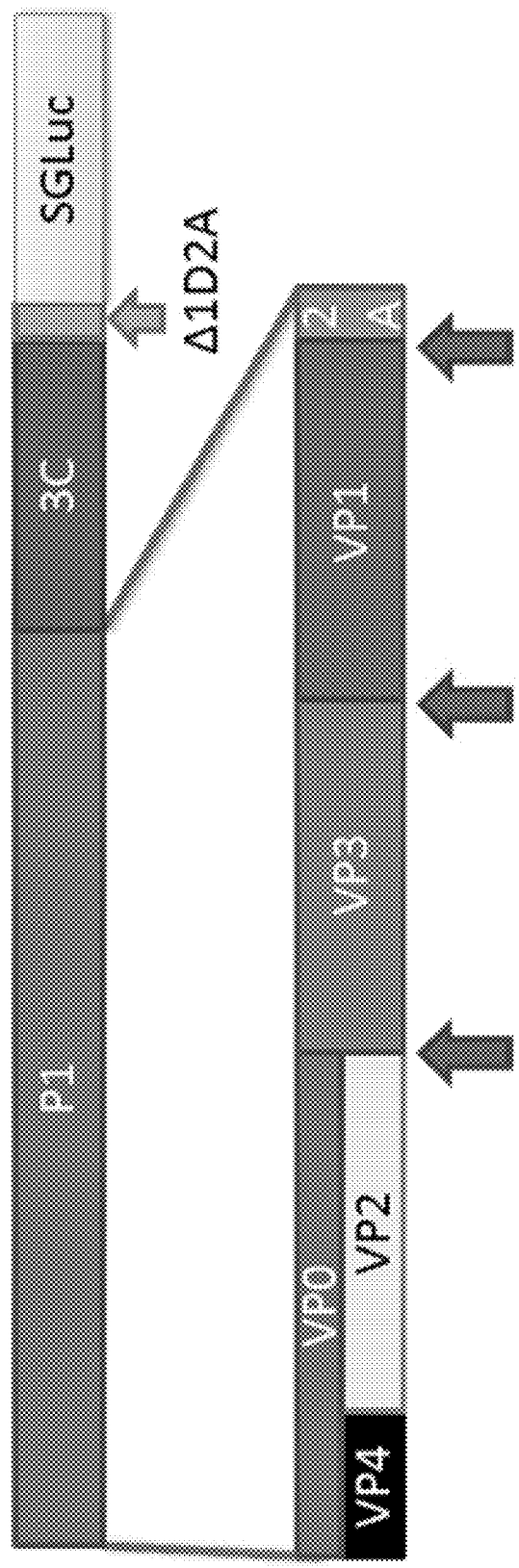
FIG. 7 diagrams a construct comprising the P1 precursor protein, the 3C protease, Δ1D2A translation interrupter, and SGLuc. The lower part of FIG. 7 shows the relative positions of individual viral proteins VP0, VP1, VP2, VP3, VP4 and 2A within the FMDV P1 polypeptide precursor. The site of translation interruption between 3C and SGLuc is indicated by the light gray Δ1D2A arrow on the top diagram and the sites of proteolytic P1 precursor protein cleavage by FMDV 3C protease are marked by dark arrows at the bottom of FIG. 7.

To check for processing of the P1 polypeptide, a second set of constructs containing the P1 polypeptide precursor derived from FMDV O1 Manisa, followed by a nucleotide sequence encoding for a wild-type or a mutant 3C protease with a C-terminal Δ1D2A sequence fused to it, followed by SGLuc, was constructed (O1P1-3C-SGLuc) (see for example, FIG. 7).

Figure 8:
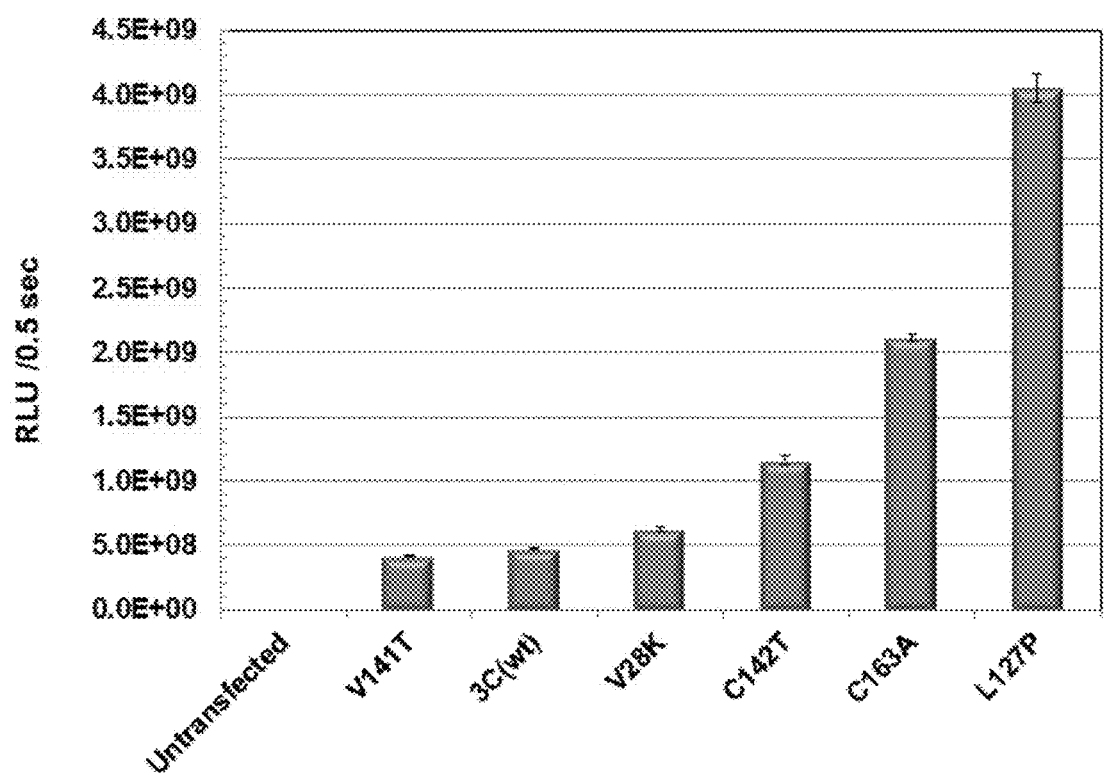
FIG. 8 compares luciferase activity of HEK293-T cells that have not been transfected (first bar), or have been transfected with vectors expressing P1-3C-SGLuc constructs (bars 2-7) where the FMDV P1 was derived from FMDV serovar O1 Manisa and the FMDV 3C was derived from FMDV serovar Asia Lebanon 89. The constructs depicted by bars 2-7 respectively contain the following substitutions to the 3C protease sequence: V141T (bar 2), wild-type (bar 3, no substitution), V28K (bar 4), C142T (bar 5), C163A (bar 6) and L127P (bar 7). Luciferase activity levels are represented in terms of relative light units (RLU) per unit of time (RLU/0.5 s.) Similar to the constructs in FIG. 6, high levels of luciferase activity were observed for constructs expressing 3C protease modified at C142T, C163A and L127P.

Assay readings of the O1P1-3C-SGLuc constructs of FIG. 8 showed a similar distribution as those seen for the GLuc-3C constructs. The most notable difference is the heightened luciferase output of the L127P construct which is now greater than seen with the C163A knockout mutation.

The primary purpose of the O1P1-3C-SGLuc constructs was to evaluate the ability of wild-type and mutant FMDV 3C proteases to process the P1 polypeptide precursor in vivo (within the HEK293-T cells). To accomplish this, transfected HEK293-T cell lysates were run on protein gels for western blots to detect fully processed viral capsid proteins VP1-VP4 (see FIGS. 9A-9G). The only mutant to show no processing of the P1 polypeptide was the complete activity knockout C163A. The two bands present with the anti-VP2 antibody represent the VP0 intermediate and the fully processed VP2 polypeptide. Both bands are present in all samples that show processing however the VP2 band is very weak in the V141T sample. Among all Western blot samples shown in FIGS. 9A-9G, it is clear that the L127P and C142T mutants possess the highest expression while maintaining proteolytic activity towards the P1 polypeptide precursor, based on the strong bands indicating VP2, VP3 and VP1 presence as shown specifically in FIGS. 9D and 9F. FIG. 9A showing a Western image of HEK293-T cells transfected with the Δ1D2A-SGLuc construct of SEQ ID NO: 150 serves as a negative control to the analysis.

Example 13: Formation of Virus-Like Particles (VLPs) in HEK293-T Cells

To examine for the presence of VLPs, transfected cell cultures were examined under transmission electron microscopy (TEM) for the presence of arrays of empty capsids. Based on the luciferase readings and Western blot analyses, HEK293-T cells transfected with O1P1-3C(wt)-SGLuc, O1P1-3C(C142T)-SGLuc, or O1P1-3C(L127P)-SGLuc were examined for VLP formation, to compare the two most promising mutations to the wild-type. Crystal arrays of FMDV VLPs were found in cells HEK293-T cells transfected with O1P1-3C (wt)-SGLuc or O1P1-3C(C142T)-SGLuc, or O1P1-3C(L127P)-SGLuc, as seen in FIGS. 10A-B, FIGS. 11A-B, and FIG. 36B respectively.

Example 14: Evaluation of the L127P/C142T Double Mutant

Figure 12:
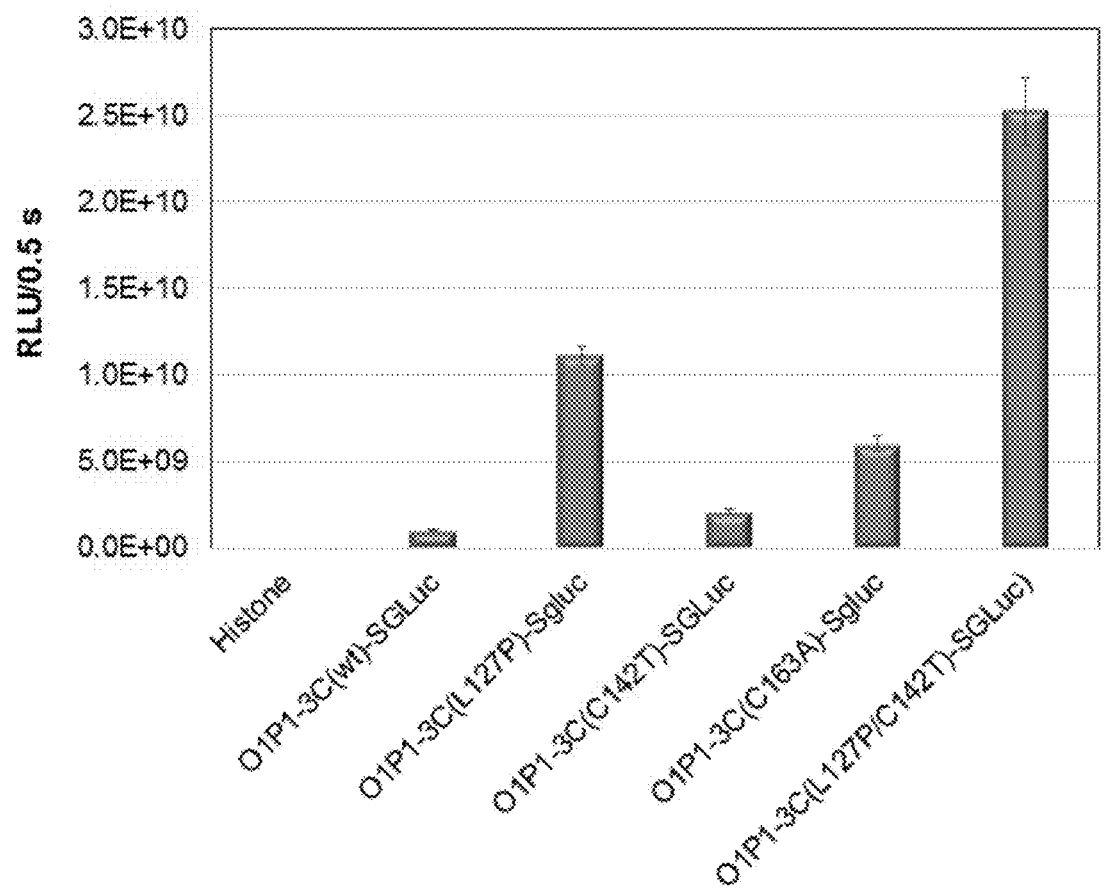
FIG. 12 compares luciferase activity of HEK-293-T cells that express histone H3 instead of luciferase (first bar), or that have been transfected with vectors expressing P1-3C-SGLuc constructs (bars 2-7) where the P1 component was derived from the O1 Manisa serovar of FMDV while 3C component was derived from the Asia Lebanon 1989 serovar of FMDV. The constructs depicted by bars 2-6 respectively contain the following substitutions to the 3C protease sequence: wild-type (bar 2, no substitution in 3C), L127P (bar 3), C142T (bar 4), C163A (bar 5) and L127P/C142T (double mutant, bar 6). Luciferase activity levels are represented in terms of relative light units (RLU) per unit of time (RLU/0.5 s.) Similar to the luciferase activity of the constructs in FIGS. 6 and 8, higher levels of luciferase activity were observed for constructs expressing 3C protease modified at L127P, C142T or C163A. Significantly higher levels of luciferase activity were observed for the double mutant L127P/C142T.
Figure 13:
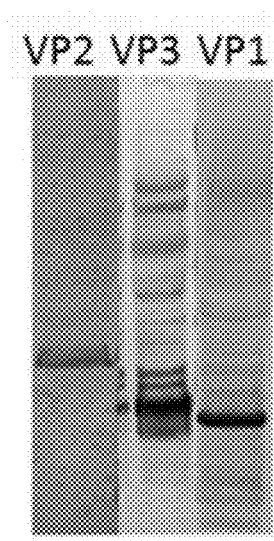
FIG. 13 is a Western blot image of a lysate of HEK-293-T cells transfected with an O1P1-3C(L127P/C142T)-SGLuc construct probed with antibodies to VP2, VP3 or VP1. These results show the ability of the L127P/C142T double mutant of FMDV 3C protease to process and cleave the P1 polypeptide protein precursor.
Figure 14A:
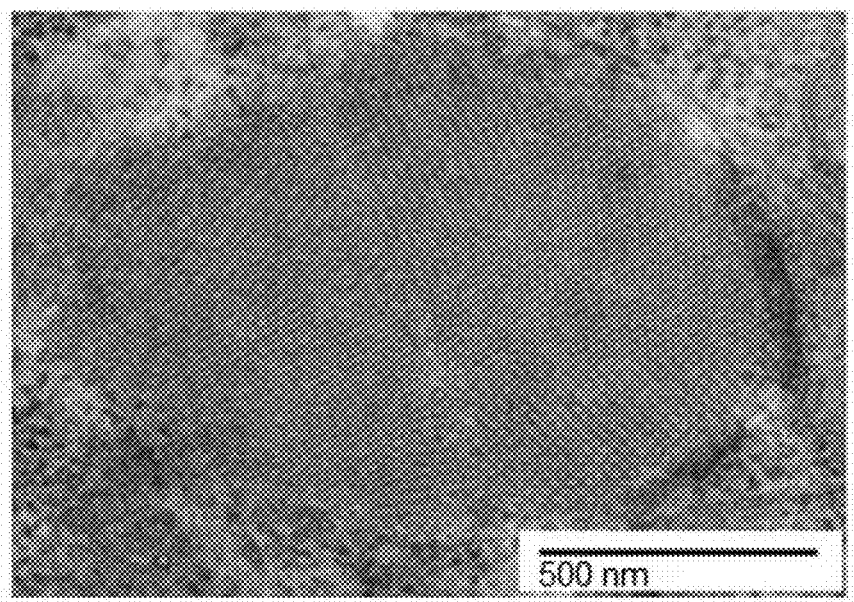
FIG. 14A is a TEM image at 20,000× magnification of HEK293-T cells expressing the O1P1-3C(L127P/C142T)-SGLuc construct, showing formation of VLP crystal arrays.
Figure 14B:
FIG. 14B is a TEM image at 7000× magnification of HEK293-T cells expressing the O1P1-3C(L127P/C142T)-SGLuc construct, showing formation of VLP crystal arrays.

Combining the L127P and C142T mutations into a single O1P1-3C(L127P/C142T)-SGLuc construct (SEQ ID NO: 135) dramatically enhanced transgene output when processing the P1 polypeptide of O1 Manisa (SEQ ID NO: 102) (see FIG. 12), and results in an enhancement roughly 25× over the construct with the wild-type FMDV 3C protease. The L127P/C142T construct retained the ability to process the P1 polypeptide precursor, as seen in FIG. 13, as well as the ability to form arrays of VLPs in transfected cell cultures, as shown in FIGS. 14A and 14B.

Example 15: Evaluation of FMDV 3C Protease Expression Towards E. coli

The FMDV 3C wild-type and mutant proteases (L127P, C142T, L127P/C142T and C163A) were expressed in E. coli, and evaluated for the ability of the proteases to process the P1 polypeptide precursor in E. coli by sodium dodecyl sulfate-polyacrylamide gel electrophoresis (SDS-PAGE) analysis and their toxicity towards the bacterial host cells by cell growth assays in both plated, solid and liquid growth media having kanamycin selection.

Accordingly, a construct containing the P1 polypeptide precursor derived from FMDV O1 Manisa, was prepared as described herein and cloned into pET-SUMO vector (ThermoFisher Scientific) which had the SUMO tag removed prior to cloning of the P1 polypeptide. A construct encoding the FMDV 3C wildtype and mutant proteases (L127P, C142T, L127P/C142T and C163A) with a N-terminal FLAG tag (SEQ ID NO: 190) was prepared as described herein and cloned into pSNAP vector (New England Biolabs) according to manufacturer's instructions.

Figure 15:
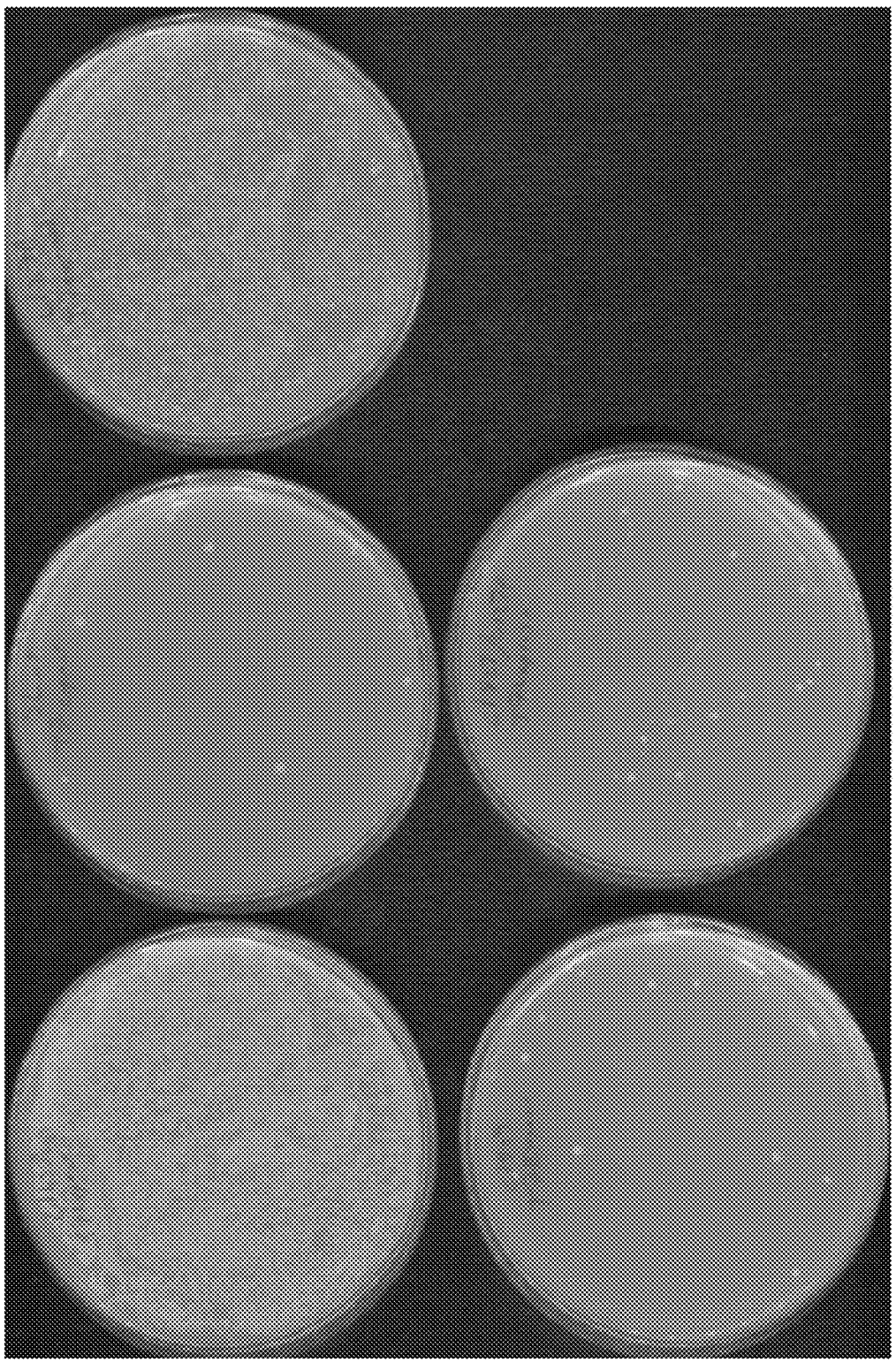
FIG. 15 shows that E. coli expressing L127P-(upper row right) or C163A-(upper row left) modified 3C exhibited more bacterial growth than those expressing wild-type FMDV 3C (upper row center), C142T-(lower row left), or L127P/C142T-(lower row right) modified FMDV 3C protease, as determined by bacterial colony count.
Figure 16:
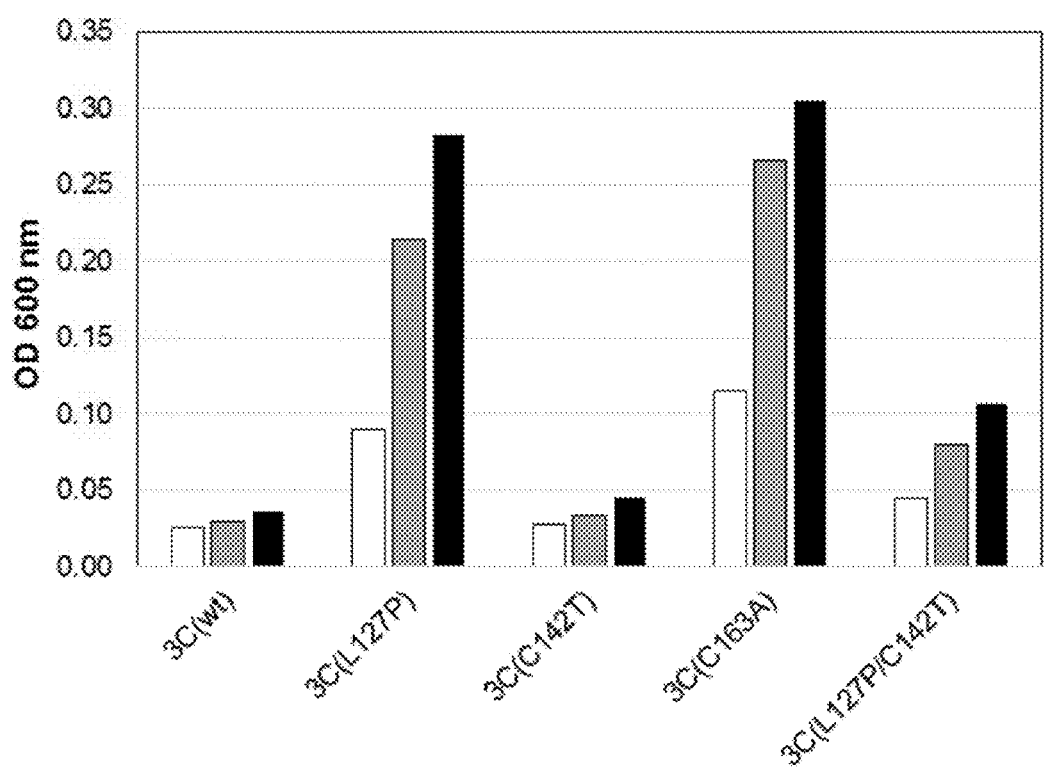
FIG. 16 shows that E. coli transformed with constructs expressing L127P-modified 3C protease and C163A-modified 3C protease exhibited significantly higher growth rates as determined by absorbance or optical density ($OD_{600}$) than E. coli transformed with constructs expressing native, unmodified 3C, C142T-modified 3C or L127P/C142T-modified 3C protease. These results suggest that the L127P 3C protease mutant is an excellent choice for expression of FMDV viral proteins in E. coli.

The cell growth assays in plated and liquid growth media having kanamycin selection indicate that the wild-type and mutant C142T FMDV 3C proteases are toxic towards E. coli while the knock-out mutant C163A FMDV 3C protease and mutant L127P FMDV 3C protease are not toxic. Double mutant L127P/C142T FMDV 3C protease appears to be more toxic than the C163A and L127P mutants but less toxic than the wild-type and the C142T mutant (see FIGS. 15 and 16).

Figure 17:
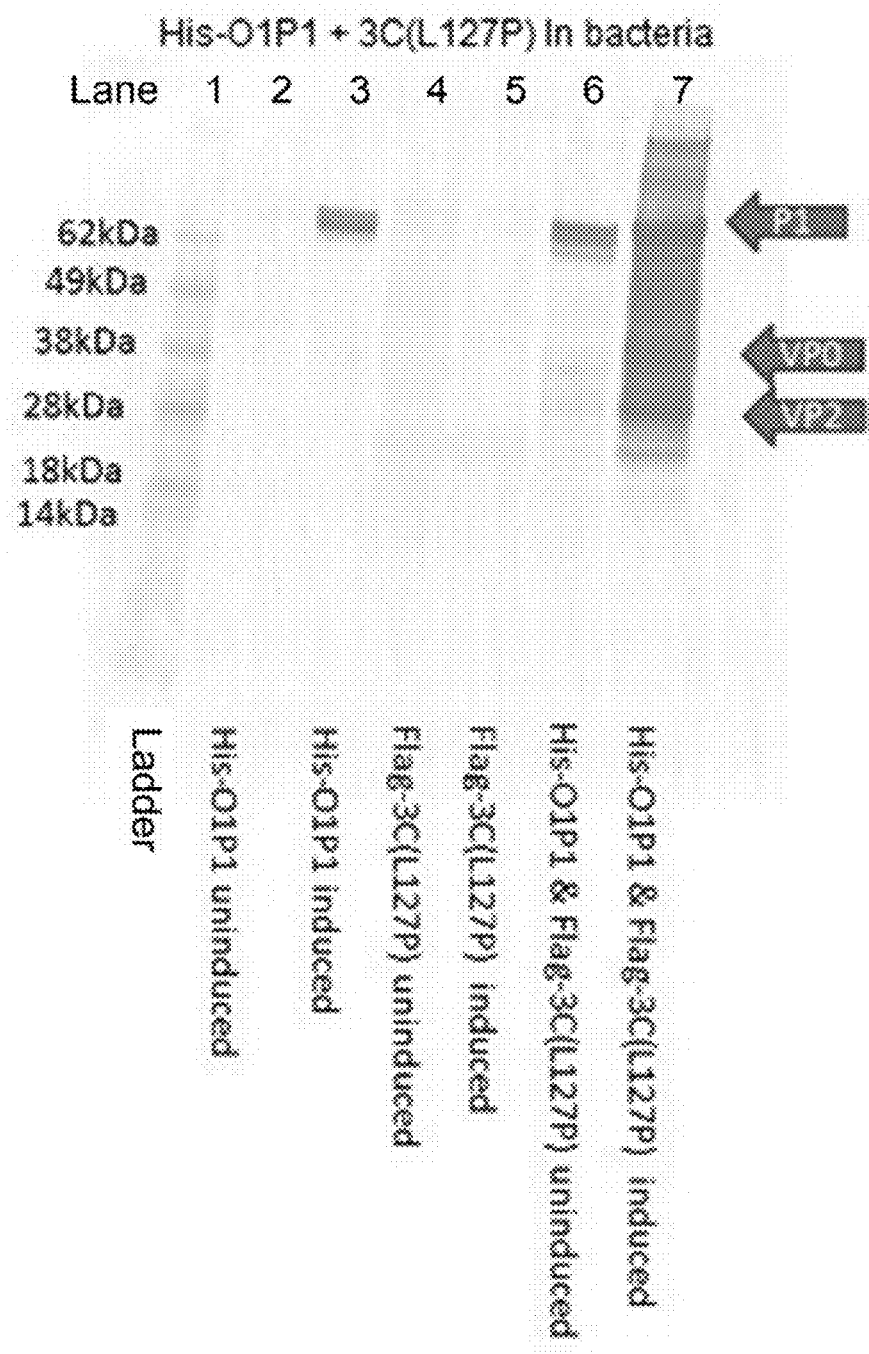
FIG. 17 shows that the modified L127P-3C protease as expressed in E. coli can proteolytically process FMDV P1 protein co-expressed in E. coli.

Further, as shown in FIG. 17, *E. coli* cells containing induced and uninduced P1 polypeptide precursor (Lanes 2 and 3), induced and uninduced mutant L127P FMDV 3C protease (Lanes 4 and 5), and induced and uninduced P1 polypeptide precursor and mutant L127P FMDV 3C protease (Lanes 6 and 7) are analyzed by western blotting with the F14 (anti-VP0/VP2) mouse monoclonal antibody. FIG. 17 shows that the mutant L127P FMDV 3C protease retains its ability to process the P1 polypeptide precursor in *E. coli*.

Overview of Examples 16-29

Monitoring protein expression in vitro and in vivo can pose significant hurdles. Current methods are typically antibody based methods such as western blotting or ELISA assays. For expression of transgene upon vaccination verification of expression requires testing for immune response. This can cause complications during vaccine testing because a lack of immune response does not absolutely indicate a failure of the vaccine to be expressed.

For in vitro work unless the protein of interest is secreted these assays typically require the lysis of expressing cells in order to harvest expressed proteins. This can result in a need for multiple samples which increases the number of variables in an experiment. When dealing with transfected cell lines this can subject an experiment to different transfection efficiencies which can alter results. An ideal situation would be to link expression of a secreted easily detectable biomarker with expression of any protein of interest. Such a system would allow for rapid determination of overall expression by monitoring cell culture media rather than needing to lyse cells. A similar system in vivo using a biomarker that can be detected in the blood stream would greatly aid in vaccine design and testing as it would allow for confirmation of expression in an independent manner from immune responses.

*Gaussia princeps* luciferase (GLuc) is fast becoming a valuable molecular tool. GLuc is naturally secreted from expressing cells and capable of an intense luminescent burst while only being 185 amino acids in size. It has been used for in vivo work as GLuc is able to be detected in blood, plasma, and urine samples. The luminescent output of GLuc was enhanced through the mutation of two residues, F89W and I90L, resulting in a super-luminescent 8990 GLuc (SGLuc) variant with a shifted peak emission wavelength of 481 nm from 470 nm. If incorporated into a poly-cistronic expression system the secreted nature of GLuc and subsequent GLuc variants, such as SGLuc, would make an excellent method to monitor overall protein expression both in vitro and in vivo.

Polycistronic vectors have been created using several methods including multiple internal ribosome entry sites, proteolytic cleavage, self-processing peptides, and others. The Foot and Mouth Disease Virus (FMDV) 2A gene codes for a self-processing peptide that functions as a translational interrupter separating the P1 and P2 regions of the FMDV polypeptide in a non-proteolytic manner. The efficiency of 2A mediated translational interruption is dependent upon the amino acid sequence used. For the most efficient form of translational interruption to occur an additional sequence derived from the C-terminus of the VP1 protein must be present. Other 2A like sequences have been found including in the other members of the Aphthovirus family, however the FMDV 2A sequence remains the most efficient at separation. Previous research has incorporated 2A sequences to create poly-cistronic vectors capable of expressing multiple proteins for a wide range of uses.

Creation of a chimeric fusion between GLuc and 2A provides a mechanism by which protein expression could be easily monitored. In vitro, such a chimera would confer the benefit of being able to monitor changes in protein expression of transfected cells over time and provide a control for differences in transfection efficiency. This would greatly reduce experimental variables and allow for more reliable time course studies. If incorporated into a vaccine construct, it could potentially allow for a direct correlation between expressions of vaccine peptides with luciferase activity.

In Examples 16-29, the creation and testing of six distinct chimeras between GLuc or SGLuc and the FMDV 2A translational interrupter sequence are described. The effect of placement on the N- and C-terminus for GLuc/SGLuc on luciferase activity is evaluated. In addition, two DNA chimeras where the start codon of GLuc or SGLuc luciferase gene is deleted, are created. The effect of the addition of a SGLuc chimera has on the creation of FMDV VLPs in cell culture is also evaluated.

It is found that regardless of whether or not the 2A sequence is on the N- or C-terminus, all six chimeras retained the ability to be secreted and to luminesce. Regardless of which terminus of GLuc/SGLuc the Δ1D2A sequence is added to, it does not fully inhibit either secretion or luminescence. However, placement of the Δ1D2A on the C-terminus of GLuc/SGLuc does have a notable impact on luminescence but is still readily detectable in cell culture. The presence of Δ1D2A on the N-terminus of GLuc or SGLuc allows for the deletion of the methionine at position one of the GLuc or SGLuc genes without major deleterious effect to either luminescence or secretion. Finally, the present inventors surprisingly found that when such a chimera is added to the C-terminus of a vaccine construct capable of producing FMDV VLPs, it allows for verification of protein expression and the formation of VLPs in vitro.

GLuc or SGLuc chimeras are useful in vaccine design and development. When testing new vaccines, it is often unknown if the vaccine failed to produce the transgenic product in the test subject or if the immune system of the test subject failed to respond to transgene produced by the vaccine. The inventors have surprisingly discovered that embodiments of GLuc or SGLuc chimeras of the present invention provide a means to confirm protein production from the vaccine in vivo.

Example 16: Insertion of GLuc into pTarget and Cloning of H3 into pTarget

*Gaussia* luciferase (GLuc) template sequence was inserted in the pTarget vector as described in Example 1 to form pTarget-GLuc.

To clone Bovine Histone H3 into pTarget, cDNA synthesized from bovine RNA was utilized as a template. PCR was performed as per manufacturer's instructions using OneTaq 2× Master Mix with Standard Buffer (New England Biolabs) with primers H3-F (SEQ ID NO: 175) and H3-R (SEQ ID NO: 176). Sequencing to confirm insertion of Histone H3 coding sequence into the pTarget vector was performed by sequencing with primers T7 (SEQ ID NO: 179) and Seq-R (SEQ ID NO: 180) and analysis of sequencing data was analyzed by Sequencher 4.8 program (Genecodes).

Example 17: Site Directed Mutagenesis of GLuc

Site directed mutagenesis of GLuc was performed using the GENEART® Site-Directed Mutagenesis System (Invitrogen) as per manufacturer's instructions with primers SGLuc8990-MF (SEQ ID NO: 177) and SGLuc8990-MR (SEQ ID NO: 178). Confirmation of mutation was performed by sequencing with primers T7 (SEQ ID NO: 179) and Seq-R (SEQ ID NO: 180) and analysis of sequencing data was analyzed by Sequencer 4.8 program (Genecodes).

Example 18: Construction of GLuc/SGLuc-Δ1D2A Chimeras

For the construction of GLuc-Δ1D2A chimera, PCR amplification was performed with pTarget-GLuc as a template using OneTaq 2× Master Mix with Standard Buffer (New England Biolabs) and primers T7 (SEQ ID NO: 179) and GLuc-NS-NheI-R (SEQ ID NO: 181) per manufacturer's instructions. PCR product was digested with NheI-HF and XhoI (New England Biolabs) restriction enzymes as per manufacturer's instructions.

A construct containing the Δ1D2A sequence in a pCRII vector was used as a cloning template for construction of GLuc-Δ1D2A. The vector was digested with NheI-HF and XhoI restriction enzymes (New England Biolabs) as per manufacturer's instructions. Ligation of digested GLuc sequence into digested pCRII vector was performed using T4 DNA ligase (Roche) as per manufacturer's instructions. Creation of the GLuc-Δ1D2A chimera in the pCRII vector was confirmed by sequencing with T7 (SEQ ID NO: 179) and GLuc-NS-NheI-R (SEQ ID NO: 181) and analysis of sequencing data was analyzed by Sequencher 4.8 program (Genecodes).

For the insertion of GLuc-Δ1D2A into pTarget plasmid, PCR amplification was performed with pCRII GLuc-Δ1D2A as a template and using OneTaq 2× Master Mix with Standard Buffer (New England Biolabs) and primers AscI-Kzk-Gluc-F (SEQ ID NO: 182) and 2A-XmaI-R (SEQ ID NO: 196). Confirmation of insertion was performed by sequencing with primers T7 (SEQ ID NO: 179) and Seq-R (SEQ ID NO: 180) and analysis of sequencing data was analyzed by Sequencher 4.8 program (Genecodes).

To create SGLuc-Δ1D2A, site directed mutagenesis was performed using the GENEART® Site-Directed Mutagenesis System (Invitrogen) as per manufacturer's instructions with primers SGLuc8990-MF (SEQ ID NO: 177) and SGLuc8990-MR (SEQ ID NO: 178) and using pTarget Gluc-Δ1D2A as a template. Confirmation of mutation was performed by sequencing with primers T7 (SEQ ID NO: 179) and Seq-R (SEQ ID NO: 180) and analysis of sequencing data was analyzed by Sequencher 4.8 program (Genecodes).

Example 19: Construction of Δ1D2A-GLuc/SGLuc Chimeras

For the construction of Δ1D2A-GLuc/SGLuc chimeras, a nucleotide sequence encoding the Δ1D2A-SGLuc sequence was synthesized by Genscript in the pUC57 kan vector. PCR amplification was performed using OneTaq 2× Master Mix with Standard Buffer (New England Biolabs) and primers AscI-Kzk-2A-F (SEQ ID NO: 185) and Gluc-R-NotI (SEQ ID NO: 186) per manufacturer's instructions. Insertion into the pTarget vector (Promega) followed manufacturer's instructions for T/A cloning. Confirmation of insertion was performed by sequencing with primers T7 (SEQ ID NO: 179) and Seq-R (SEQ ID NO:180) and analysis of sequencing data was analyzed by Sequencher 4.8 program (Genecodes).

To construct the Δ1D2A-Gluc chimera the pTarget Δ1D2A-SGLuc construct was used as a template for site directed mutagenesis using the GENEART Site-Directed Mutagenesis System (Invitrogen) as per manufacturer's instructions with primers Gluc8990-MF-2 (SEQ ID NO: 197) and Gluc8990-MR-2 (SEQ ID NO: 198). Confirmation of mutation was performed by sequencing with primers T7 (SEQ ID NO: 179) and Seq-R (SEQ ID NO: 180) and analysis of sequencing data was analyzed by Sequencher 4.8 program (Genecodes).

Example 20: Construction of Δ1D2A-GLuc Δ1M (SEQ ID NO: 151) and Δ1D2A-SGLuc Δ1M Chimeras (SEQ ID NO: 152)

To construct Δ1D2A-Gluc/SGLuc Δ1M chimeras the appropriate pTarget Δ1D2A-GLuc or pTarget Δ1D2A-SGLuc construct was used as a template for site directed mutagenesis using the GENEART Site-Directed Mutagenesis System (Invitrogen) as per manufacturer's instructions with primers No Met Gluc-MF (SEQ ID NO: 187) and No Met Gluc-MR (SEQ ID NO: 188). Confirmation of mutation was performed by sequencing with primers T7 (SEQ ID NO: 179) and Seq-R (SEQ ID NO: 180) and analysis of sequencing data was analyzed by Sequencher 4.8 program (Genecodes).

Example 21: Construction of P1-3C and P1-3C-SGLuc Constructs

The nucleotide sequence derived from FMDV O1 Manisa serotype and coding for the P1 polypeptide (SEQ ID NO: 136) was synthesized by Genscript. Nucleotide sequence coding for the P1 polypeptide was cloned into a modified pTarget vector using BamHI-HF and NotI-HF restriction enzymes (New England Biolabs) as per manufacturer's instructions. For the preparation of the P1-3C construct, insertion of 3C was performed by using PCR amplification with primer NotI-3CLeb89-F (SEQ ID NO: 173) and primer 3CLeb89-EcoRI-R (SEQ ID NO: 199). For the preparation of the P1-3C-SGLuc construct, insertion of 3C was performed by using PCR amplification with primers NotI-3CLeb89-F (SEQ ID NO: 173) and 3Casia-ns-EcoRI-R (SEQ ID NO: 184). The sequence for 2A-SGLuc was then inserted behind the 3C sequence by digestion of the synthesized template provided by Genscript with EcoRI-HF and XmaI restriction enzymes (New England Biolabs) as per manufacturer's instructions. All ligations were performed as previously described herein.

Example 22: Transfection and Harvesting of HEK293-T Cells

HEK293-T cell line was a generous gift from USDA-ARS-FADRU. Cells were grown in 1×MEM media (Gibco) with 10% Fetal Bovine Serum defined (HyClone), 1× Antibiotic-Antimycotic (Gibco), 1×MEM-NEAA (non-essential amino acids) (Gibco), and 1× Glutamax (Gibco). Cells were transfected at passage 58 in a six-well plate using Lipofectamine 2000 (Invitrogen) as per manufacturer's instructions. After incubating for 24 hours in a 37° C. CO2 incubator, media from transfected cells was removed and stored in a 2 mL tube at 4° C. To harvest cell lysates 200 μl al of 2× Luciferase Cell Lysis Buffer (ThermoFisher Scientific) was added to each well and pipetted to remove cells attached to the plate. Cell lysates were put in a 1.5 ml tube and stored at −70° C.

Example 23: Luciferase Assay

Luciferase activity was measured using a 96-well Bio-Systems Veritas luminometer (Turner Biosystems). For unadjusted samples, 20 µl of harvested media was used and readings taken with no delay after an injection of 25 µl of 100 µM water soluble coelenterazine solution (NanoLight Technologies, Pinetop Ariz.). An integration time of 0.5 s was used for data collection both before and after injection of coelenterazine. Readings for pre-injection were used to establish a baseline of light emission at the time of injection and subsequently subtracted from the post-injection values during data analysis. Replicates were averaged together to give relative light units per half second (RLU/0.5 s).

To adjust for differential expression of transgene amongst samples harvested media was mixed with 4× NuPage LDS Sample Buffer (Invitrogen), heated at 97° C. for 10 minutes, then loaded into wells on 10-well NuPage 4-12% Bis-Tris gels (Invitrogen). Gels were run in 1×MES buffer (Invitrogen) at 200 V for 35 minutes. Samples were then transferred onto membranes using the i-Blot system (Invitrogen). Membranes were incubated in 5% milk blocking buffer for 40 minutes then washed three times with 1×PBS-T buffer (EMD Millipore) at 5 minutes each. A 1:1000 dilution of Rabbit polyclonal Antisera-Gluc (NanoLight Technologies, Pinetop Ariz.) was used for primary antibody incubation while shaking at room temperature for 1 hour. Three washes were repeated with 1×PBS-T for 5 minutes each after primary antibody incubation. A 1:500 dilution of goat anti-rabbit-HRP secondary antibody was then applied and allowed to incubate while shaking at room temperature for 1 hour followed again by three washes with 1×PBS-T for 5 minutes each. DAB staining was performed using SIGMA-FAST 3,3'-Diaminobenzidine tablets (Sigma) dissolved in 15 mL of ddH2O for 1 hour followed by de-staining with two rounds of washing with 1×PBS-T for 5 minutes. Volumes of media loaded onto the gel were adjusted until equal loading was obtained for each sample.

Luciferase assay on equilibrated samples was performed as described above with the only difference being the usage of adjusted volumes of cell culture media determined by analysis of western blots as a sample. Media from untransfected HEK293-T cells was used to dilute samples in order to maintain a constant volume.

To measure the effects of cell lysis buffers on luminescence 10 µl harvested GLuc and SGLuc media was mixed with 90 µl of either cell culture media, 2× Luciferase Cell Lysis Buffer (ThermoFisher), or MPER (Invitrogen). A total of 100 µl was used in each well with no delay after an injection of 25 µl of 50 µM water soluble coelenterazine solution (NanoLight Technologies, Pinetop Ariz.). An integration time of 0.5 seconds was used for data collection both before and after injection of coelenterazine.

Example 24: Transfection of LF-BK αV/β6 Cells

The LF-BK αV/β6 cell line was grown in 1×DMEM media (Gibco) with 10% Fetal Bovine Serum defined (HyClone), 1× Antibiotic-Antimycotic (Gibco), 1×MEM-NEAA (Gibco), and 1× Glutamax (Gibco). Cells were transfected at passage 44 in a six well plate using Lipofectamine 2000 (Invitrogen) as per manufacturer's instructions. After incubating for 24 hours in a 37° C. CO2 incubator media from transfected cells was removed and used for luciferase assays as described herein.

Example 25: Immunofluorescence Assay and Immune Electron Microscopy

The LF-BK αV/β6 cell line was grown in T-75 flasks for IFA and immunoelectron microscopy (I-EM). IFAs were performed using three different antibodies 6HC4, 12FE9, and F21. The 6HC4 antibody is specific to FMDV serotypes other than O when used in IFA and was used as a negative control. Antibodies 12FE9 and F21 are specific to FMDV type O VP1 and all FMDV serotype VP2 peptides, respectively. For I-EM samples are fixed in 4% paraformaldehyde with periodate and lysine in sodium cacodylate buffer, embedded in 2% agarose, partially dehydrated in ethanol, embedded in medium grade LR White resin (Electron Microscopy Sciences). Ultrathin (80 nm) sections were cut on a Leica UC6. Immunohistochemistry was performed with antibody F21 at a 1:10 dilution and goat anti-mouse ultrasmall nanogold (Electron Microscopy Sciences), enhanced with GoldEnhance EM (Nanoprobes), post stained with uranyl acetate, and imaged on a Hitachi 7600 with a 2 k×2 k AMT camera at 80 kV.

Example 26: Summary of GLuc or SGLuc Δ1D2A Chimeras Constructed

Figure 18:
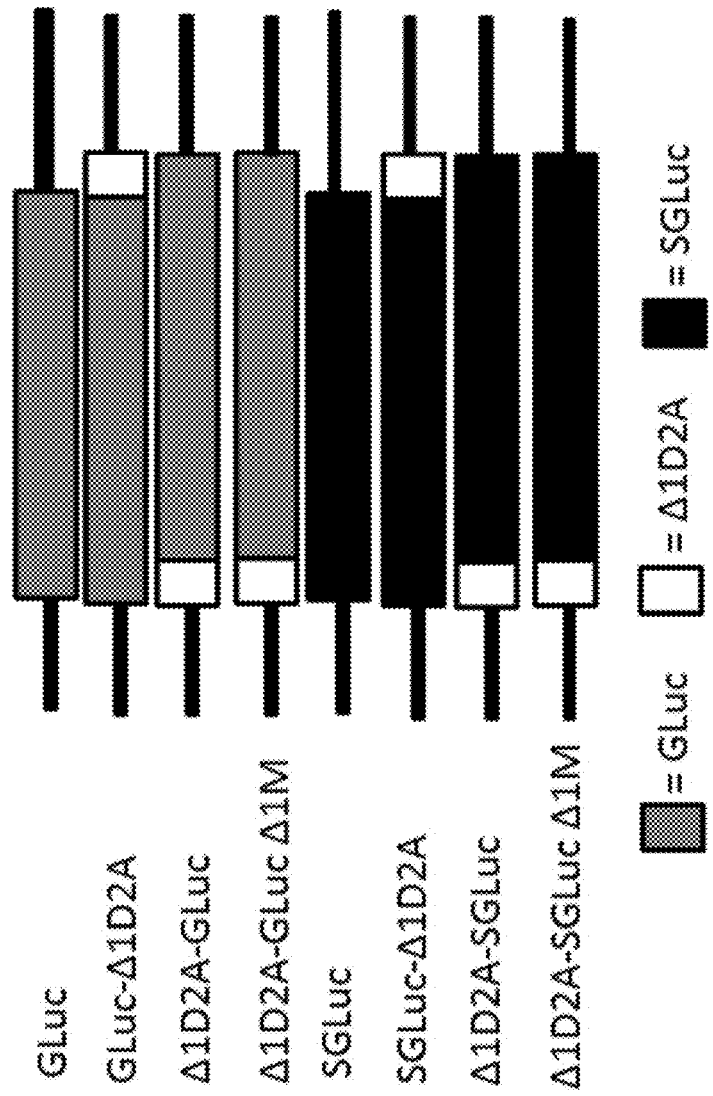
FIG. 18 is a schematic diagram describing the gene layouts of the eight different GLuc/SGLuc-Δ1D2A chimeras prepared and evaluated.

Eight different constructs were used to evaluate the effect of adding the FMDV 2A gene to GLuc/SGLuc in the present disclosure, as shown in FIG. 18.

The nucleotide sequence of construct GLuc is SEQ ID NO: 145 or 200.

The nucleotide sequence of construct SGLuc is SEQ ID NO: 146 or 202.

The nucleotide sequence of construct GLuc-Δ1D2A is SEQ ID NO: 147.

The nucleotide sequence of construct SGLuc-Δ1D2A is SEQ ID NO: 148.

The nucleotide sequence of construct Δ1D2A-GLuc is SEQ ID NO: 149.

The nucleotide sequence of construct Δ1D2A-SGLuc is SEQ ID NO: 150.

The nucleotide sequence of construct Δ1D2A-GLuc Δ1M is SEQ ID NO: 151.

The nucleotide sequence of construct Δ1D2A-SGLuc Δ1M is SEQ ID NO: 152.

Constructs GLuc-Δ1D2A, SGLuc-Δ1D2A, Δ1D2A-GLuc, Δ1D2A-SGLuc, Δ1D2A-GLuc Δ1M, and Δ1D2A-SGLuc Δ1M, are chimeras between GLuc or SGLuc and the FMDV 2A translational interrupter. The remaining two constructs were unaltered GLuc and SGLuc used as controls. To facilitate efficient separation, a modified 2A sequence identified as Δ1D2A, as shown in FIG. 4A, was utilized. This modified sequence is derived from the FMDV A24 virus and contains the truncated 11 C-terminal amino acids of VP1 (Δ1D), the defined 2A sequence, and the N-terminal proline (+1 Proline) required for highly efficient translational interruption. Constructs Δ1D2A-GLuc Δ1M and Δ1D2A-SGLuc Δ1M have the methionine at amino acid position one in the Gluc and SGLuc genes respectively deleted since it is no longer needed for translation initiation.

Example 27: Secretion and Luminescence of Constructs

Figure 19:
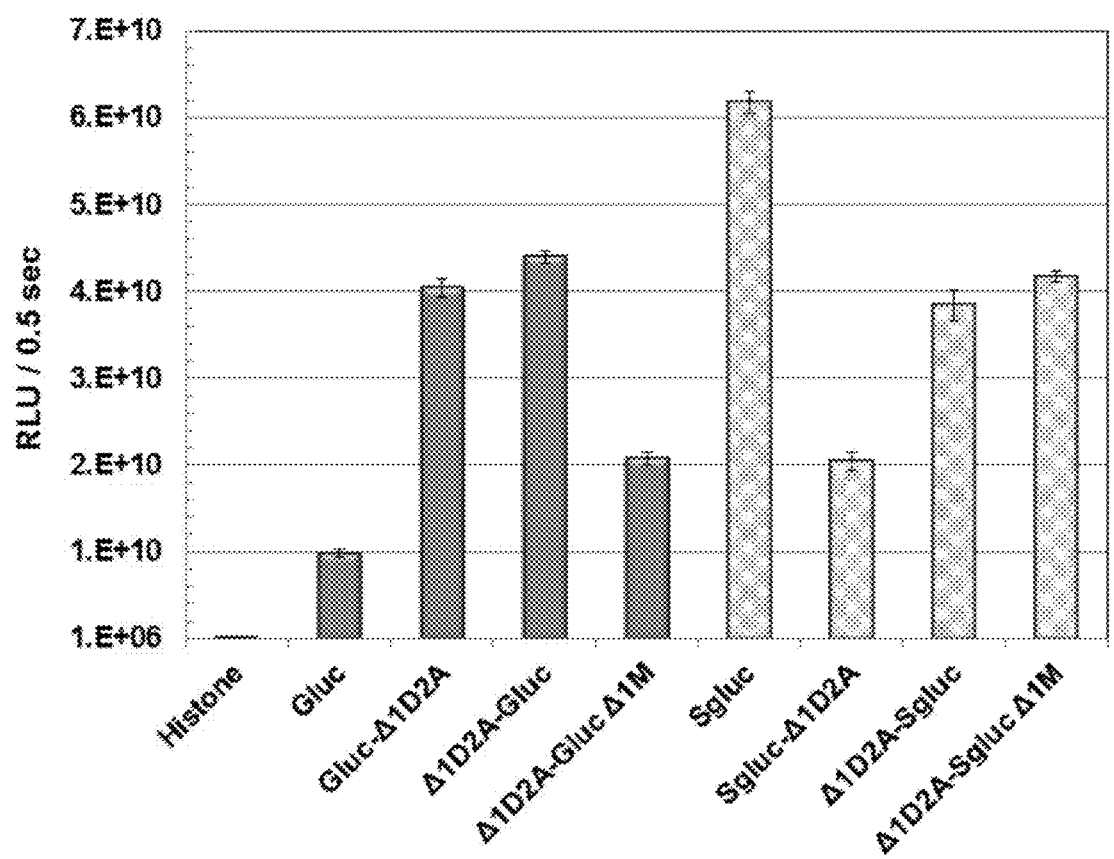
FIG. 19 is a bar graph showing RLU/0.5 second(s) (RLU per 0.5 seconds) luciferase activity levels for equal volumes of harvested supernatant medium from HEK293-T cells transfected with the eight different GLuc/SGLuc-Δ1D2A chimeras described by FIG. 18.

A concern when creating chimeras between GLuc/SGLuc and Δ1D2A was that the addition of the Δ1D2A sequence on either the N- or C-terminus might prevent secretion of the luciferase. Supernatant was taken off of transfected cell cultures and the supernatant was examined for luciferase activity. FIG. 19 shows that luciferase activity was found in all samples except the negative control confirming that addition of the Δ1D2A sequence on either the N- or C-terminus does not prevent secretion or luminescence. This data did show a peculiarity in that the addition of the Δ1D2A sequence on either the N- or C-terminus of GLuc appeared to enhance luminescence output often in excess of similar SGLuc chimeras.

A number of variables independent of enzyme activity could be capable of altering luciferase readings from transfected cell media. Minor variations in cell confluence, transfection efficiency, or minor genomic DNA contamination in plasmid preps can lead to alterations in protein expression that may give altered readings amongst samples. To account for these variables, the harvested media was taken off of transfected cell cultures and equal loading was determined by western blotting. Western blots shown in FIG. 20A confirm the 2A induced separation in N-terminal chimeras and the subsequent increase in molecular weight caused by the presence of Δ1D2A in C-terminal chimeras. Luminescent outputs were compared at the roughly equal protein concentrations as determined by western blots shown in FIG. 20A (see FIG. 20B).

Figure 20A:
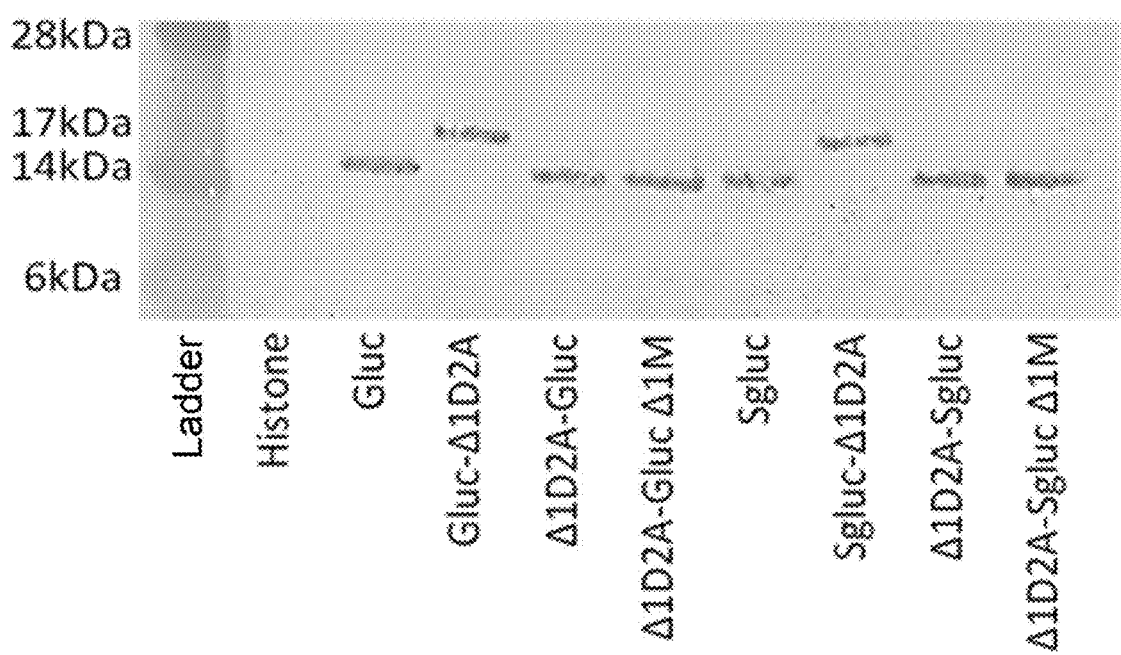
FIG. 20A is an image of a Western Blot probed with antibodies to GLuc showing approximately equal protein loading.
Figure 20B:
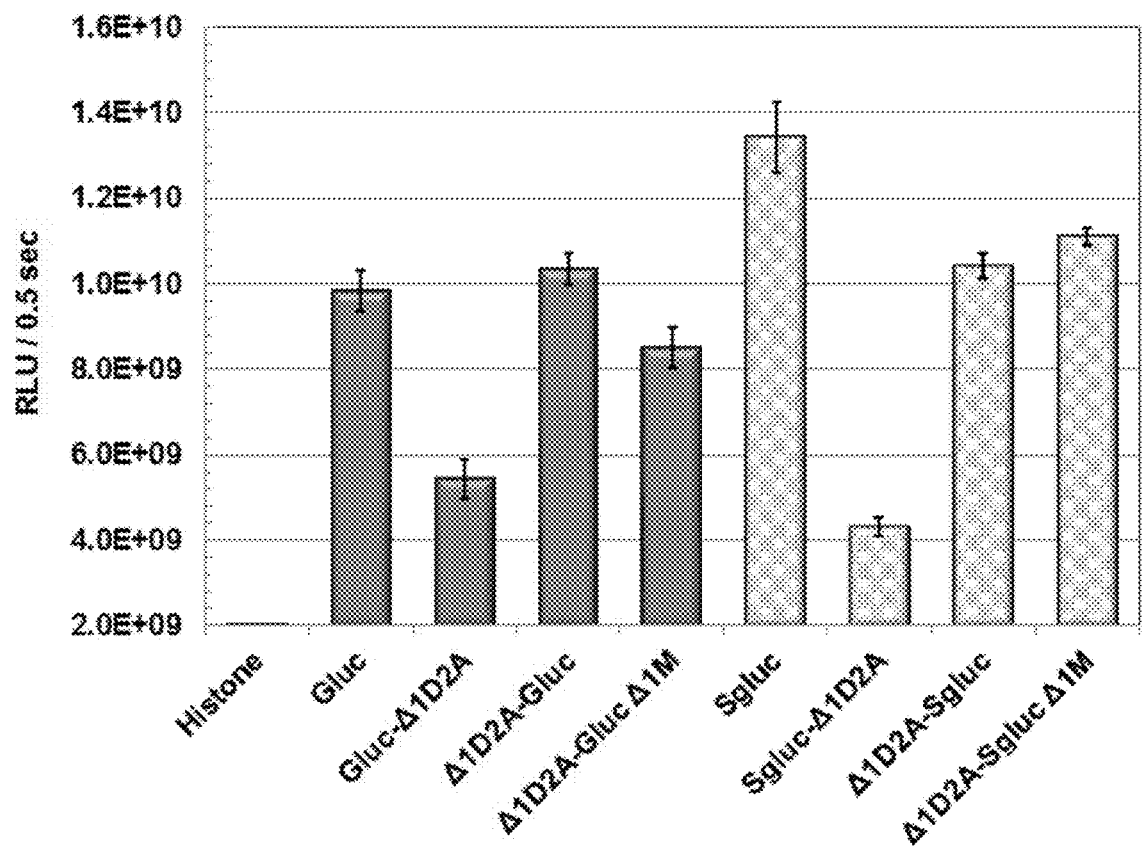
FIG. 20B is a bar graph showing RLU/0.5 second luciferase activity levels for the GLuc/SGLuc-Δ1D2A chimeras of FIG. 18 and the histone H3 negative control.

FIG. 20B show that chimeras with Δ1D2A on the C-terminus displayed reduced luminescent outputs when compared to unmodified GLuc or SGLuc and N-terminal chimeras. The deletion of the first methionine, Δ1M, from N-terminal chimeras had little to no effect on luminescent output nor did it prevent subsequent secretion.

An interesting observation was that despite previous reports identifying SGLuc variant as emitting roughly 10× stronger bioluminescence, only a moderate increase in bioluminescence when concentrations were equilibrated by western blotting was observed. Addition of Δ1D2A to either terminus negated any difference in luminescent output between GLuc and SGLuc.

Example 28: Changes in Luminescence in the Presence of Cell Lysis Buffers Induced by the 8990 Mutation Previous reports have identified two mutations at residues 89 and 90 that produce a super-luminescent GLuc variant, known as SGLuc that also shifted the peak luminescence from 470 nm to 481 nm. The previous study utilized secretion deficient mutants and lysed the cells to harvest the luciferase.

Figure 21:
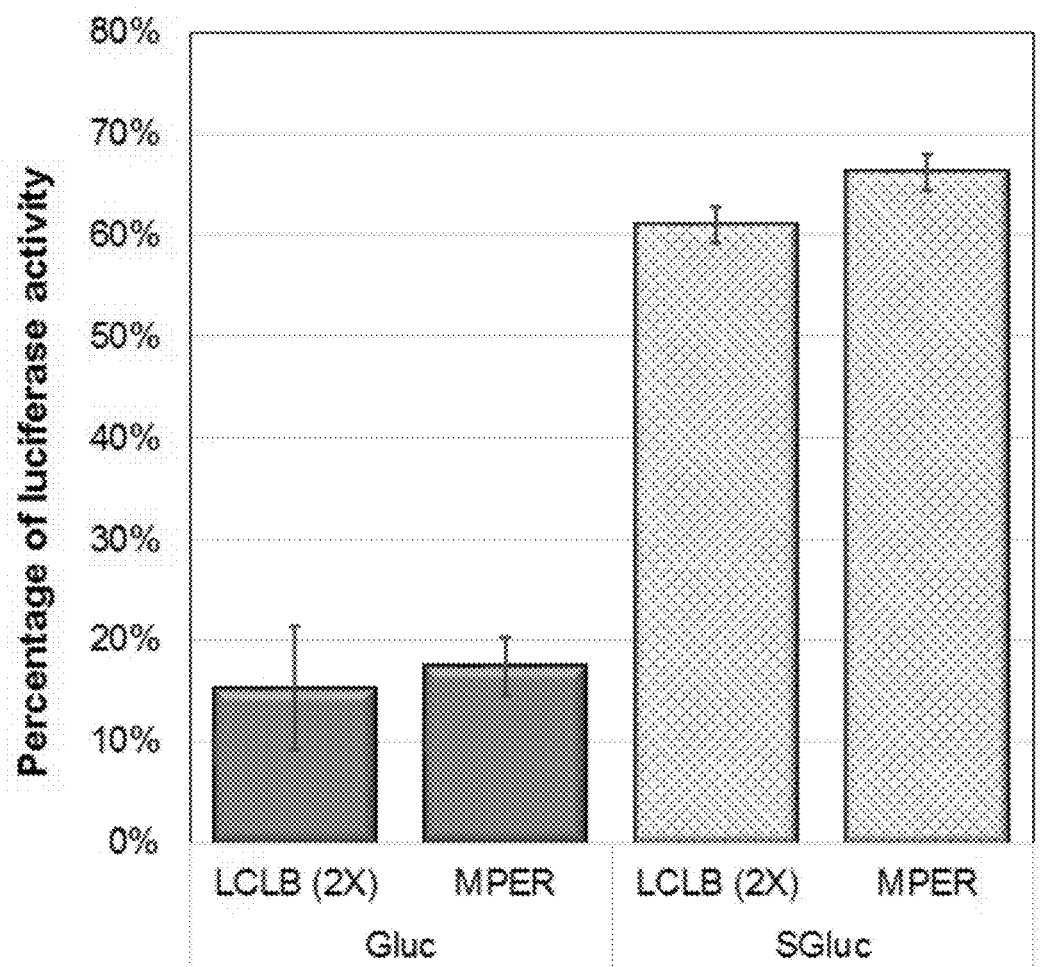
FIG. 21 is bar graph showing the percentage of total luciferase activity for GLuc and SGLuc retained in cell lysis buffers. Luciferase activity in the presence of lysis buffers is significantly higher for SGLuc than for GLuc. "LCLB": Luciferase Cell Lysis Buffer; "MPER": mammalian protein extraction reagent.

The mutations at residues 89 and 90 of GLuc also positively affect the ability of SGLuc to luminesce in cell lysis buffers. The data in FIG. 21 shows that there is a noticeable drop in the percentage of luciferase activity retained when mixed with cell lysis buffers using GLuc. This drop is lessened when using the SGLuc variant. Luciferase activity is reduced more than 80% when GLuc is mixed with cell lysis buffers compared to a reduction of less than 40% when using the SGLuc variant. This supports the conclusion that the mutations that make the SGLuc variant enhance luminescence in cell lysis buffer.

It was found in Examples 26-28 that the Δ1D2A sequence can be linked to GLuc/SGLuc in either an N- or C-terminal manner without preventing either secretion or luminescent output (see FIG. 19). The differences in luminescent output between FIG. 19 and FIG. 20B demonstrate why a system such as described here is invaluable. When adjusted to equalize protein levels in the luminescent assay of FIG. 20B, the data looks dramatically different than when simply examining harvested media (see FIG. 19). This is due to any one of a number of variables that can influence the amount of protein produced following transfection. Minimization of these variables is useful for better interpretation of experimental results. The chimeras described in the present disclosure provide a means by which these variables can be minimized and/or accounted for by using luminescent activity as a control.

The data presented in FIG. 20B shows that there is a notable difference in luminescent output between N- and C-terminal GLuc/SGLuc chimeras. The addition of the Δ1D2A sequence on the C-terminus results in a larger secreted protein and lowered luminescent output, as seen in FIGS. 20A and 20B. The addition of an N-terminal Δ1D2A does not appear to have as large of an impact on luminescent output although there is a drop when using the SGLuc variant.

One of the most unexpected findings in Examples 26-28 is that when using an N-terminal GLuc/SGLuc chimera the start codon (methionine) of the GLuc/SGLuc gene can be deleted without any major deleterious effects on luciferase activity or secretion (see FIGS. 19, 20A-20B, 21). In a non-chimeric protein removal of the methionine at position 1 of the start codon of an amino acid sequence requires the use of a form of post-translational protein processing. By creating a chimera with the Δ1D2A sequence this methionine can be effectively mutated to a proline. Separation with the N-terminal sequence is highly efficient, as there is no need for post-translation protein processing, and there are no intermediates still containing the first methionine present. The unexpected findings in Examples 26-28 demonstrate that usage of the Δ1D2A sequence can provide a valuable tool in molecular biology to examine structural and functional influences of the methionine coded for by the start codon.

Example 29: Viability of a Marker for Expression of FMD Vaccine Constructs

Figure 22:
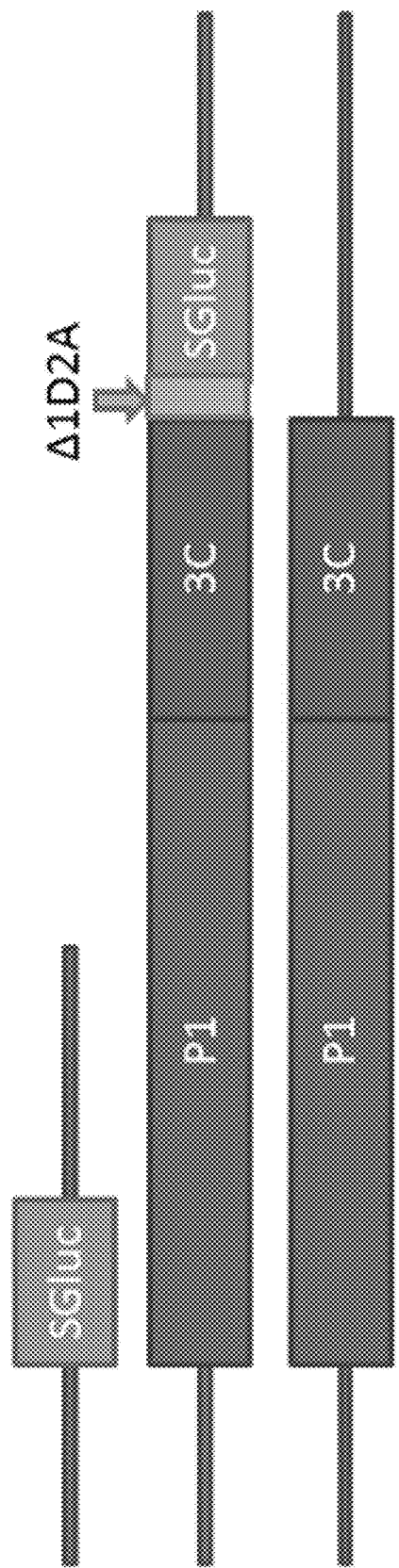
FIG. 22 is a schematic diagram illustrating of the constructs used to test for the formation of VLPs in the presence of SGLuc.
Figure 23:
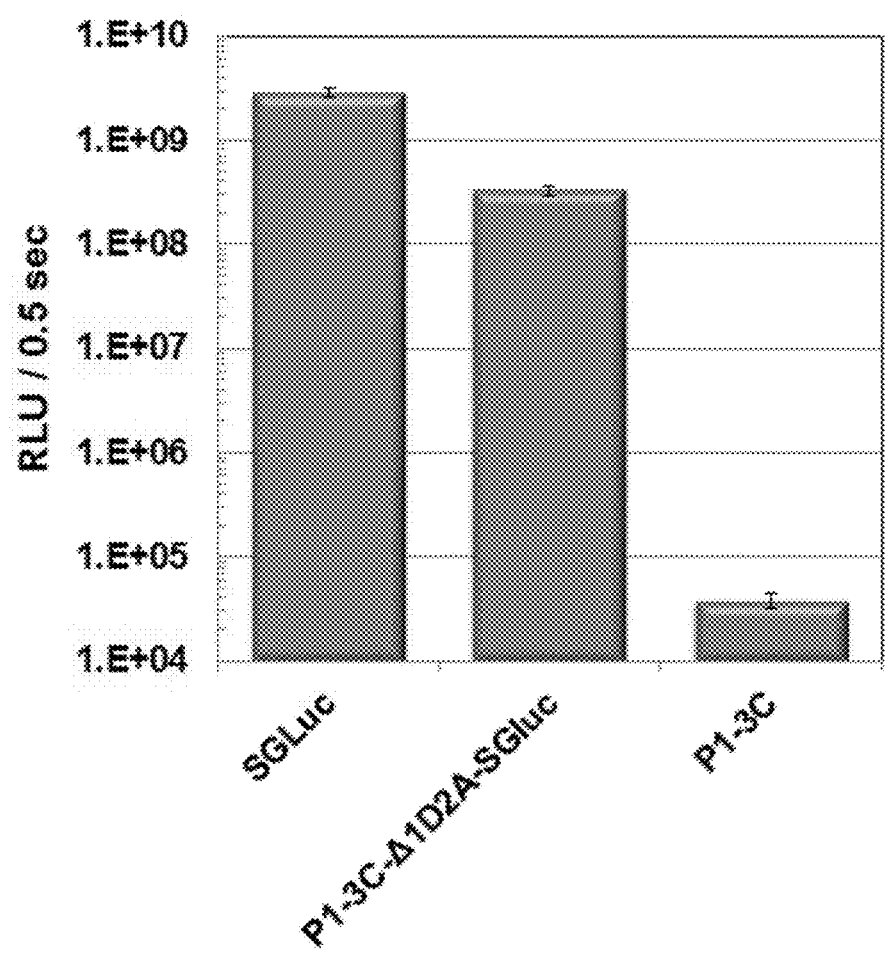
FIG. 23 is a bar graph showing RLU/0.5 second luciferase activity levels in extracellular media harvested from LF-BK αV/β6 cells transfected with SGLuc, P1-3C-Δ1D2A-SGLuc, or P1-3C as described in FIG. 22. P1 component was derived from the O1 Manisa serovar of FMDV while 3C component was derived from the Asia Lebanon 1989 serovar of FMDV.
Figures 24A, 24B, 24C, 24D, 24E, 24F, 24G, 24H, 24I:
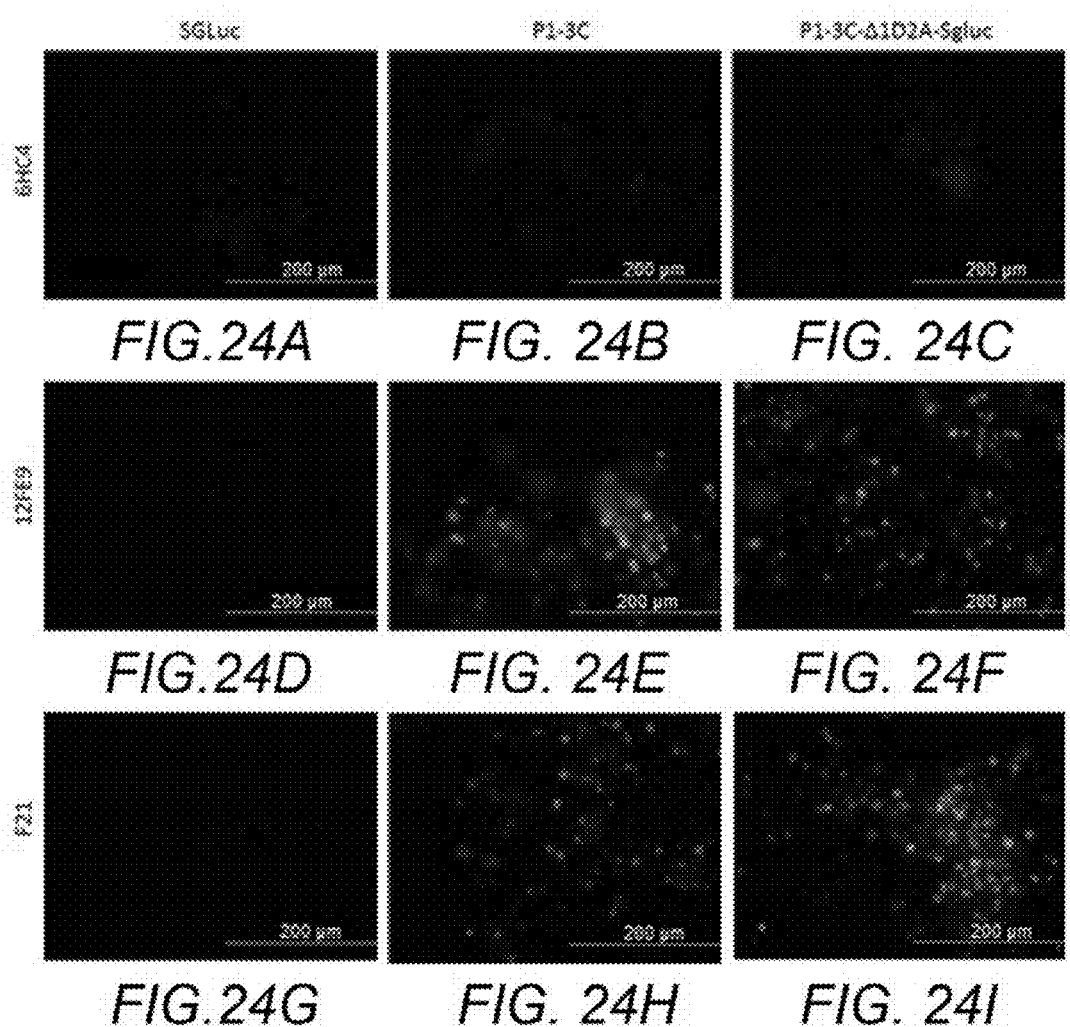
FIGS. 24A-24I depict the results of immunofluorescence (IFA) using the 6HC4 antibody, which was used as a negative control since it is specific to FMDV serotypes other than O when used in IFA, and antibodies 12FE9 and F21 which are, respectively, specific to FMDV type O VP1 and VP2 peptides for all FMDV serotypes.
Figures 25A, 25B:
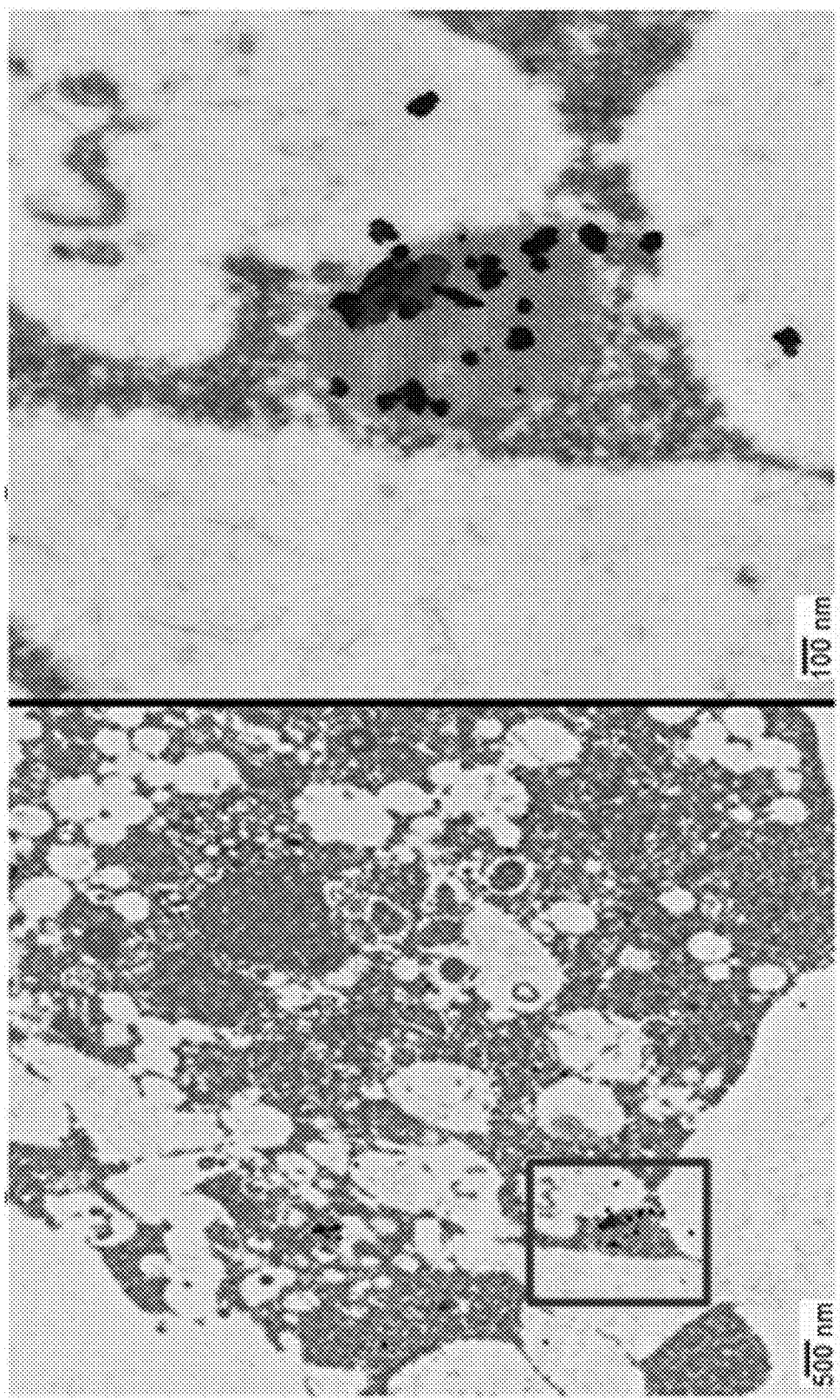
Figure 25D:
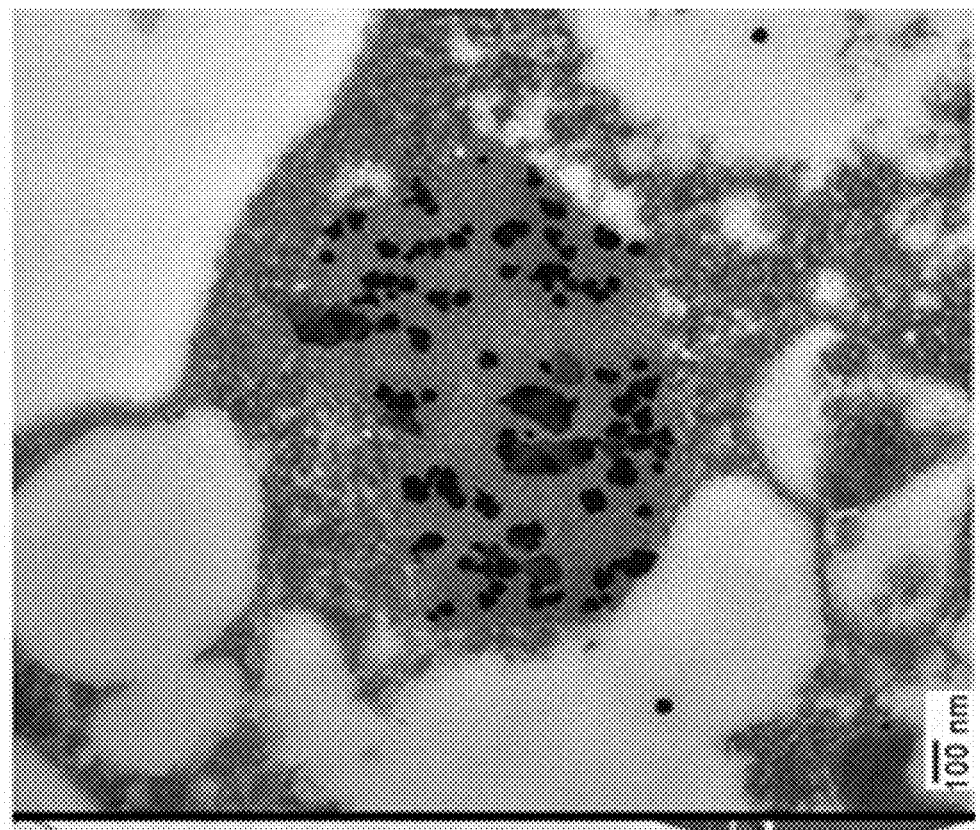
Figure 25C:
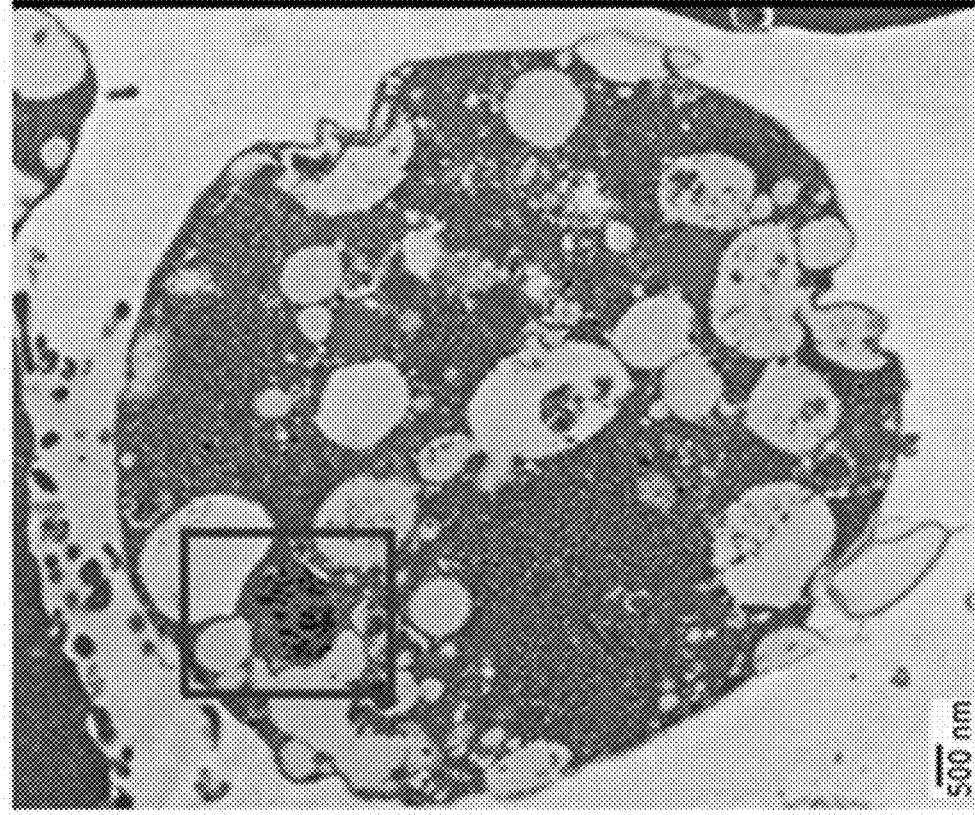

In order to ensure that the presence of the luciferase did not negatively impact the ability of an FMDV construct to form virus like particles (VLPs), a plasmid vector carrying one of the three constructs set forth in FIG. 22 was included in transfected cell cultures. A plasmid encoding SGLuc alone "mpTarget SGLuc" construct (SEQ ID NO: 153) was used as a control for the experiment and the Δ1D2A-SGLuc was placed on the C-terminus of an FMDV construct capable of creating VLPs using the FMDV O1 Manisa serotype as a template for the P1 polypeptide. Media from transfected cells was tested for luciferase activity. As seen in FIG. 23, no luciferase activity was detected in the P1-3C construct, "mpTarget P1-3C" construct (SEQ ID NO: 155), which did not have the SGLuc gene. Luciferase activity was detected in both cells transfected with SGLuc only and the P1-3C-Δ1D2A-SGLuc construct, "mpTarget P1-3C-Δ1D2A-SGLuc" construct (SEQ ID NO: 154). Luminescent output of the construct with Δ1D2A-SGLuc was significantly higher than background luminescent levels, as seen in FIG. 23.

Immunofluorescence assays (IFA) were performed to confirm expression of FMDV peptides in transfected cells, using three different antibodies 6HC4, 12FE9, and F21, as shown in FIGS. 24A-24I. The 6HC4 antibody is non-reactive with FMDV type O serotype when used in IFA and was used as a negative control. Antibodies 12FE9 and F21 are reactive to FMDV type O1 Manisa VP1 and VP2 peptides respectively.

A minor level of background activity was seen in all three samples with the 6HC4 antibody. No significant reactivity with either 12FE9 or F21 was seen in the cells transfected with plasmid containing only SGLuc (see FIG. 24D and FIG. 24G respectively). Reactivity with only 12FE9 and F21 were seen in both the P1-3C and the P1-3C-Δ1D2A-SGLuc samples (see FIGS. 24E, 24F, 24H, and 24I). This confirms that FMDV O1 Manisa capsid proteins were being expressed in transfected cell cultures.

Confirmation of FMDV expression in transfected cells by IFA does not confirm VLP formation. Therefore, to evaluate whether or not VLP formation was being impaired, immune-electron microscopy (I-EM) was performed on P1-3C and the P1-3C-Δ1D2A-SGLuc samples, as shown in FIGS. 25A-25D. Previous reports in the literature indicate that when FMDV is examined under electron microscopy, crystalline arrays of capsids are observed. Such similar structures in both cells transfected with the P1-3C-Δ1D2A-SGLuc and P1-3C plasmids indicative of VLP formation in both samples in FIGS. 25A-25B and FIGS. 25C-25D, respectively.

Hence, the presence of the Δ1D2A-SGLuc in the construct did not prevent the expression, (as shown in FIGS. 24A-24I), or function, (as shown in FIGS. 25A-25D), of the FMDV peptides in the plasmid construct. The construction of VLPs in cell culture, as shown in FIGS. 25A-25D, is a particularly critical step in FMD vaccine development as it shows the ability to construct structures akin to those seen in normal FMDV infection.

Example 30: Mechanism for Enhancement of Transgene Output by Mutant FMDV 3C Proteases The wild-type FMDV 3C protease has been shown to induce proteolytic cleavage of several host proteins, including but not limited to histone H3, nuclear transcription factor kappa B essential modulator (NEMO), Src-associated substrate in mitosis of 68 kDa (SAM68), eukaryotic translation initiation factor 4A1 (eIF4AI), and eukaryotic translation initiation factor 4G (eIF4G).

During infection with FMDV, the FMDV 3C protease processes the host eIF4AI protein causing disruption to host translational machinery. Subsequently when 3C is included in vaccine constructs it results in a similar processing of host eIF4AI which has negative implications on cellular function. To evaluate a potential mechanism for enhancement of transgene output by mutant FMDV 3C proteases, an examination of their ability to process bovine eIF4AI was performed using a cell free system.

Figure 26:
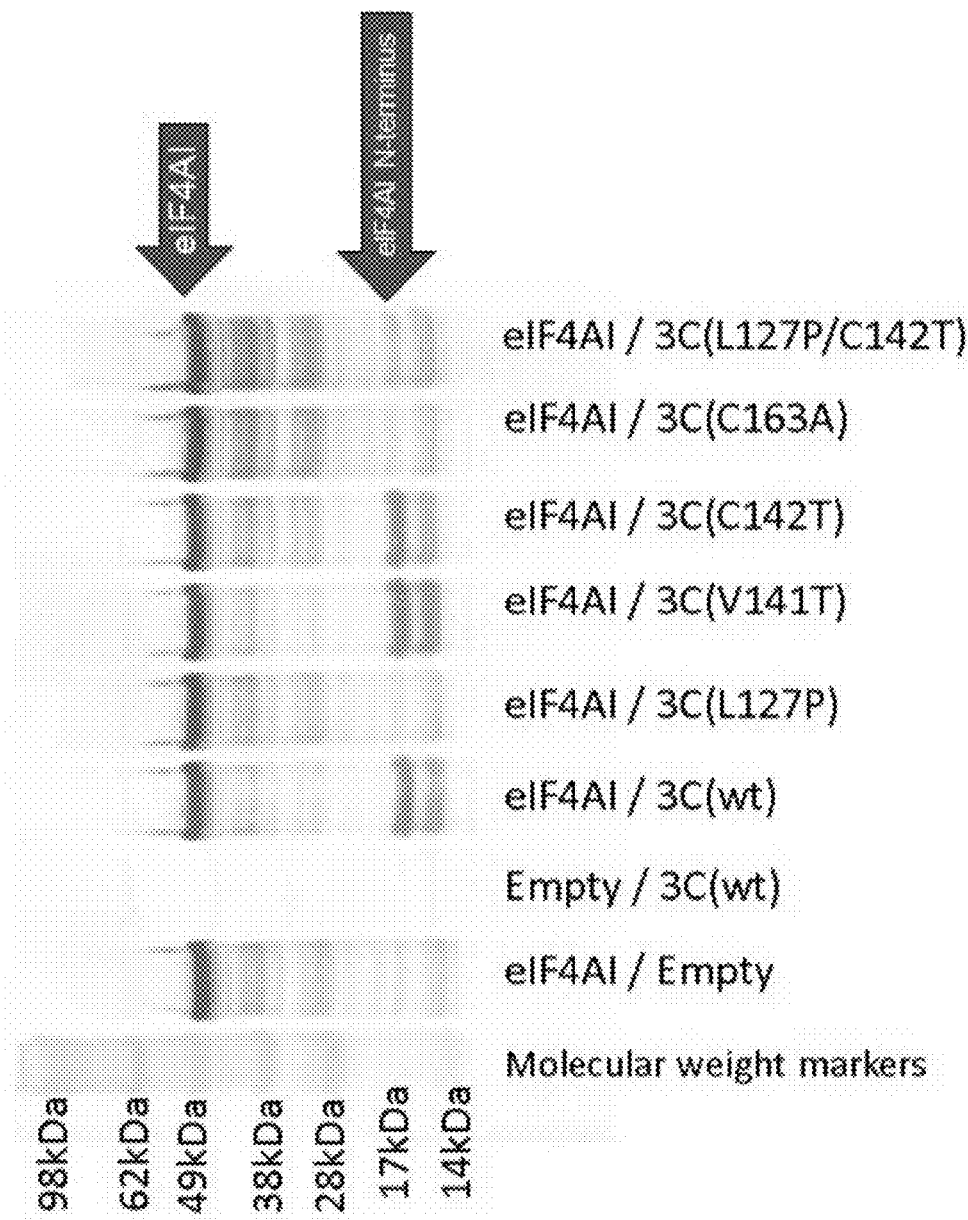

Plasmids were constructed using the pSNAP vector to express bovine eIF4AI and the individual 3C mutants. These plasmids were then used to evaluate for processing of eIF4AI in the cell free system, as shown in FIG. 26. These data show that any construct which contains the L127P mutation has significantly lowered processing of host eIF4AI when compared to other 3C mutants. This provides a mechanism by which the L127P mutation, either by itself or in conjunction with the C142T mutation, is able to enhance transgene output in transfected cell.

By preventing the processing of host eIF4AI 3C constructs containing the L127P mutation are able to prevent a significant negative consequence of FMDV 3C protease expression. This results in a more normal cellular function of cells expressing vaccine constructs which enhances the total amount of transgene product that can be produced.

Overview of Examples 31-34

The data presented in Examples 31-34 confirm that when the serotype O P1 polypeptide previously used to evaluate 3C mutants for processing and toxicity is replaced with a P1 derived from type SAT2 the FMDV 3C protease mutants retain the ability to process the P1 and the processed VPs retain the ability to form VLPs. Since the 3C region of FMDV serotypes is strongly conserved, this increases the likelihood that 3C mutations based on the Asia Lebanon 89 template will be able to process P1s from multiple serotypes and produce assembled VLPs.

Example 31: Construction of Vectors Containing SAT2P1, 3C and 2A-SGLuc Reporter (mpTarget-SAT2P1-3C-2ASGLuc)

Figure 27:
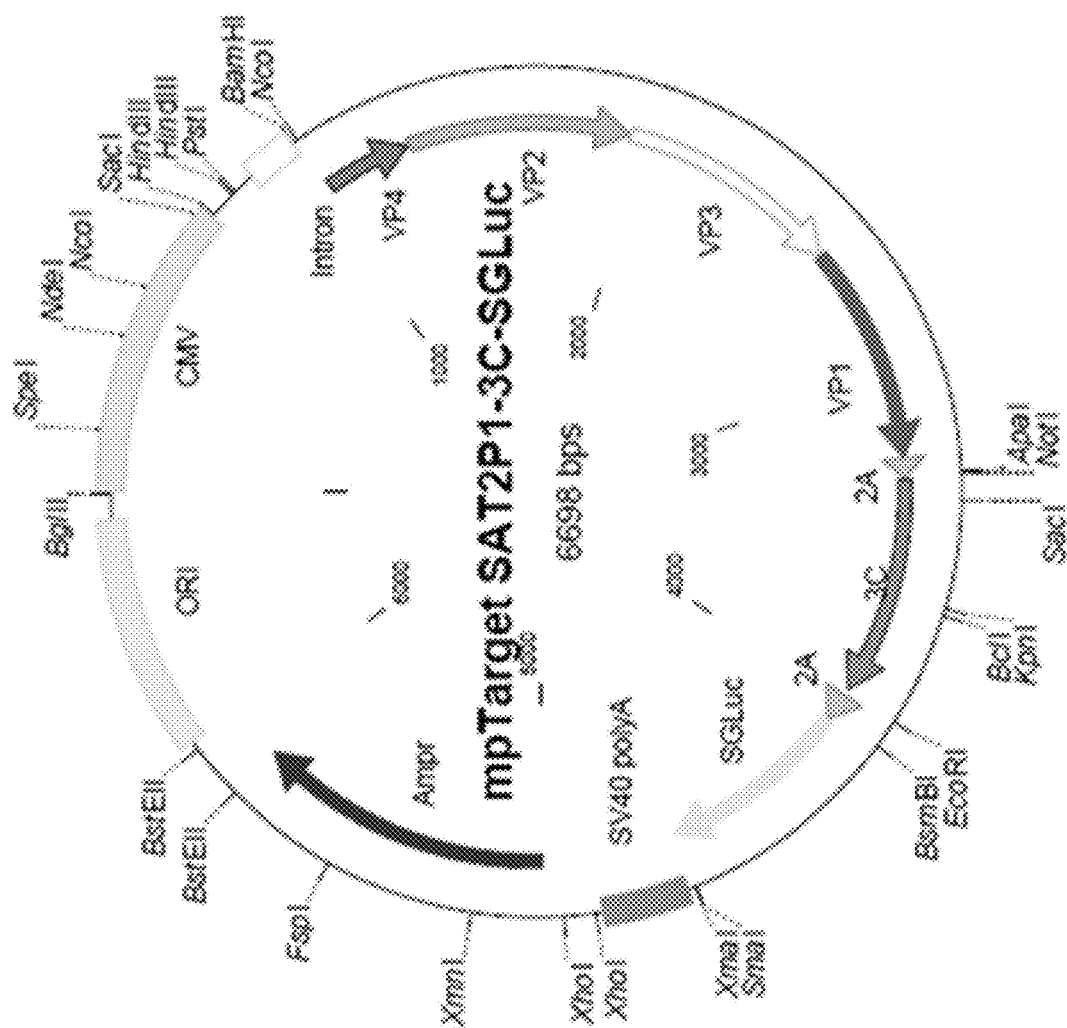

Constructs containing a P1 polypeptide derived from the SAT2 Egypt 2010 strain were created to evaluate for transgene expression, polypeptide processing, and VLP formation when using Asia Lebanon 89 wildtype 3C and derived mutants L127P, C142T, C163A, as well as the L127P/C142T double mutant. Constructs were constructed in the mpTarget vector and contains the P1 polypeptide, 3C protease, and a 2A-SGLuc luciferase reporter to monitor transgene output, as shown in FIG. 27.

Figure 28:
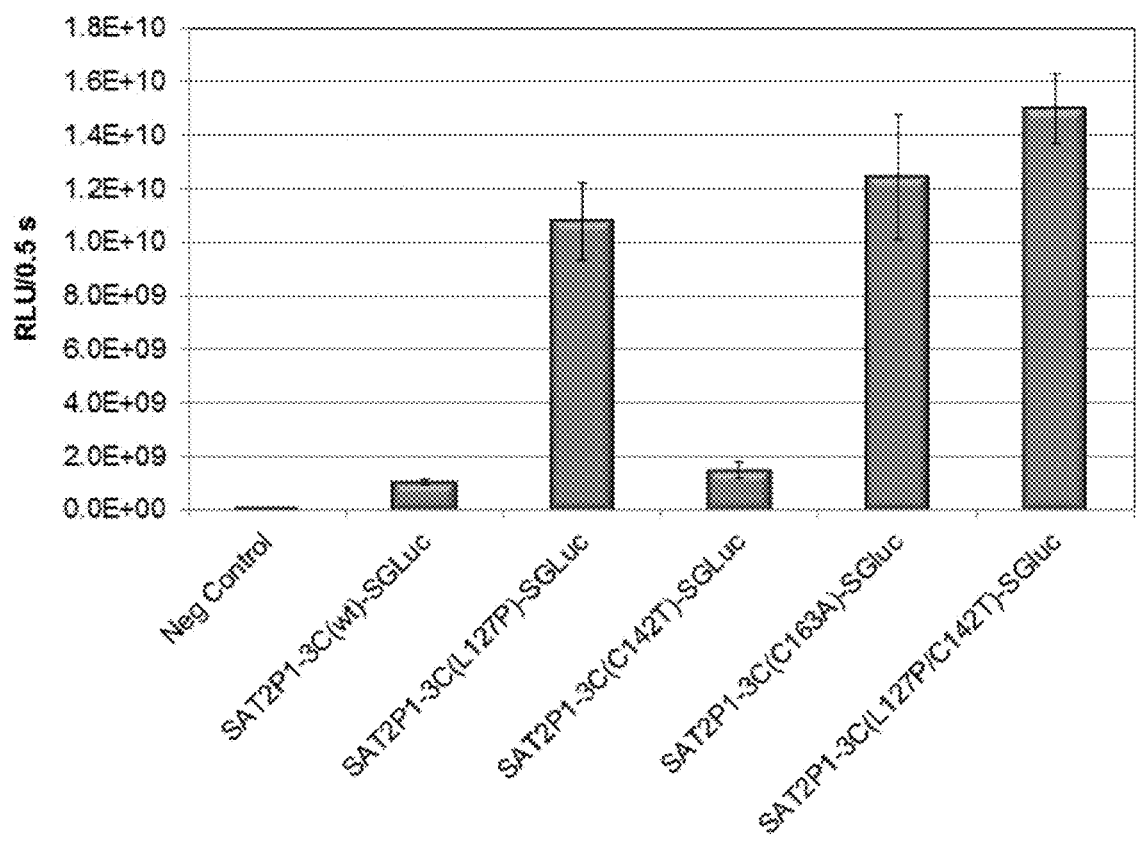

Example 32: Evaluation of Transgene Expression of mpTarget-SAT2P1-3C-2ASGLuc Constructs HEK293-T cells were transfected with each of the constructs and media monitored for luciferase activity, as shown in FIG. 28. From this data in FIG. 28, it can be observed that while the C142T mutation does not enhance transgene output as much as previously observed with the O1 Manisa P1 constructs while the L127P single mutation and L127P/C142T double mutation do retain a significant enhancement of transgene output over the wild-type FMDV 3C protease. The presence of the double mutation also continues to enhance transgene output over the single L127P mutation.

Figure 29A:
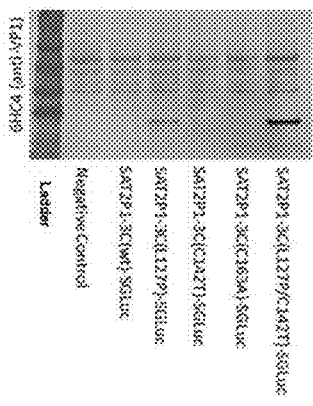
Figure 29B:
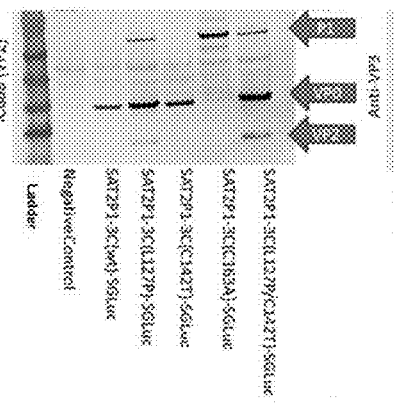
Figure 29C:
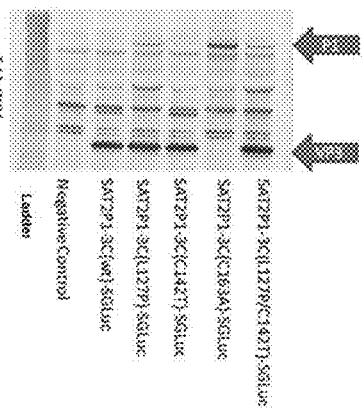

Example 33: Evaluation of P1 Processing of mpTarget-SAT2P1-3C-2ASGLuc Constructs While retention of enhanced transgene output is important what is more critical is the ability of these mutations to process the SAT2 P1 polypeptide and assemble virus like particles (VLPs). To accomplish this cell lysates of HEK293-T cells transfected with each construct were run on a protein gel and examined by western blotting. In FIGS. 29A-29C, processing of the P1 by all mutants is present with the exception of the C163A complete activity knockout. While some unprocessed P1 is retained in the L127P and L127P/C142T samples a significant amount of fully processed VPs are observed. This confirms that both mutations retain the ability to process a SAT2 P1 which has a divergent amino acid sequence from the type O serotype previously used. The lack of clear and distinct VP1 and fully processed VP2 bands in wild-type and C142T is probably due to low concentration of sample loaded onto the gel.

Example 34: Evaluation of VLP Formation of mpTarget-SAT2P1-3C-2ASGLuc Constructs Processing of the P1 polypeptide does not guarantee the formation of VLPs. To assess the retention of SAT2 P1 containing constructs to form VLPs, transfected cell cultures were examined using electron microscopy. In FIGS. 30A-30F, VLP arrays in three of the four samples that showed P1 processing can be observed. Ironically the only sample not to display VLP arrays was the wild-type 3C sample (not shown). These data confirm that the presence of the L127P, C142T, or the L127P/C142T double mutation does not prevent the formation of VLPs from a processed SAT2 P1 polypeptide. Previous to this work, VLP arrays had only been observed with type O serotypes of FMDV. The results shown in FIGS. 30A-30F represent the first observance of VLP arrays using a P1 of any FMDV serotype other than type O.

Example 35: Electronmicroscopic Confirmation of VLP Formation in Bacteria

A two plasmid system was used to produce VLPs in bacteria. The two plasmids utilized were pET His-O1P1 (SEQ ID NO: 219) and pSNAP Flag-3C(L127P) (SEQ ID NO: 220). In this system the FMDV P1 was encoded in a first plasmid while the FMDV 3Cpro sequence was encoded in a second plasmid. The pET His-O1P1 plasmid confers the ability for bacteria to grow in the presence of kanamycin while the pSNAP Flag-3C(L127P) plasmid confers the ability for bacteria to grow in the presence of ampicillin. By transforming a single bacteria with both plasmids, the bacteria is able to grow in the presence of kanamycin and ampicillin ensuring that only bacteria with both plasmids present are able to be propagated.

Bacteria were transformed with either both plasmids, pET His-O1P1/pSNAP Flag-3C(L127P), or the single pET His-O1P1. Protein expression was then induced by the addition of 1 µM IPTG. Bacteria cells were then lysed with B-PER and loaded onto a protein gel to check for expression and processing by utilizing western blotting, as shown in FIG. 31.

Figure 31:
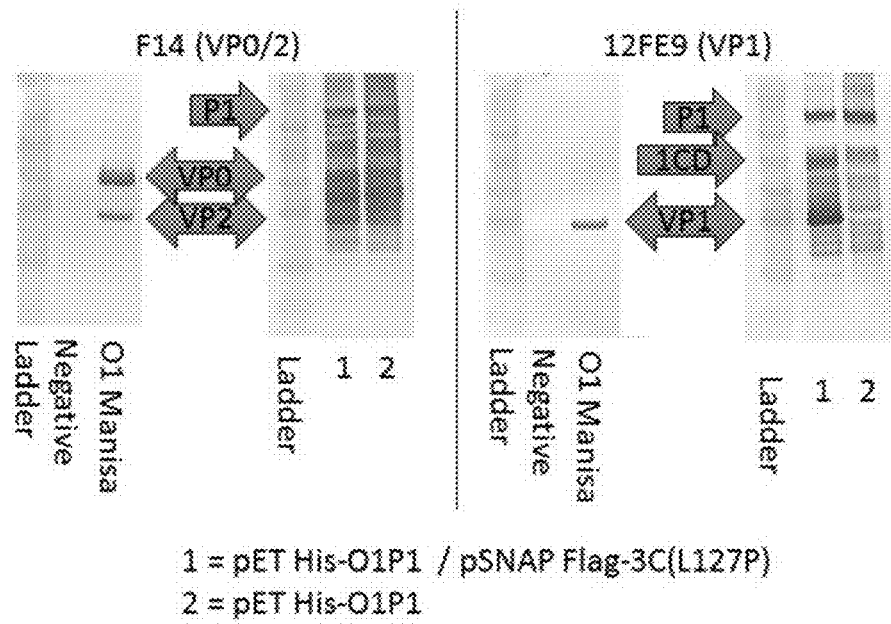
FIG. 31 depicts Western blots utilizing the F14 (anti-VP0/2) and 12FE9 (anti-VP1) antibodies to evaluate for processing in bacteria transformed with different plasmid constructs.

FIG. 31 shows a definitive band representing VP1 in the pET His-O1P1/pSNAP Flag-3C(L127P) sample and a lack of the band in the pET His-O1P1 sample which lacks any protease to process it. As expected, both samples showed the presence of the P1 precursor polypeptide. Additionally, a 1CD fusion band in the pET His-O1P1/pSNAP Flag-3C (L127P) was present in the sample, indicating of the presence of partially processed products.

Figure 32:
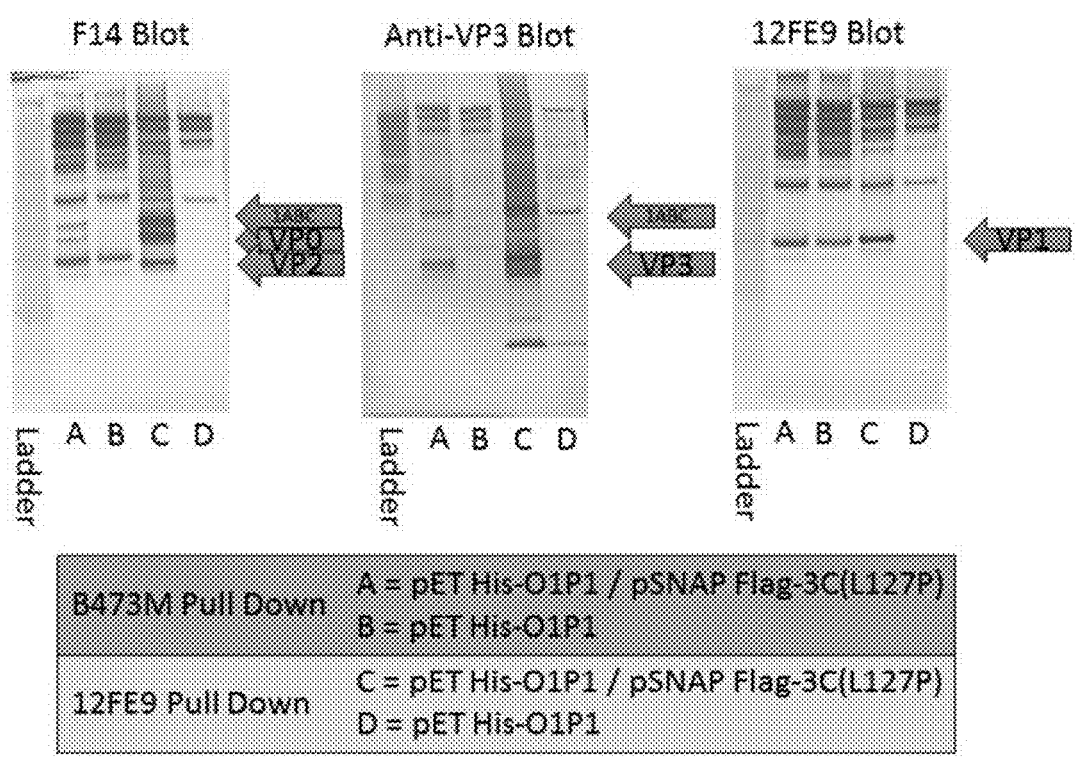
FIG. 32 shows Western blots of samples from bacteria transformed with different plasmid constructs utilized in co-immunoprecipitations with B473M and 12FE9 antibodies. Antibody B473M is specific to Type O and dependent upon the presence of secondary structures for reactivity while antibody 12FE9 is specific to VP1 and will recognize the epitope in both linear and folded confirmations. Western blots utilized F14 (anti-VP0/2), anti-VP3, and 12FE9 (anti-VP1) antibodies.

Samples of the bacterial lysate were then used for a co-immunoprecipitation assay using either the B473M antibody (ABCAM) or the 12FE9 antibody as shown by FIG. 32. The co-IPs with B473M antibody showed a weak pull down of 1ABC, VP0, VP1 and VP2, and a definitive pull down of VP3. The pull down with 12FE9 which recognizes FMDV VP1, shows a definitive capture of 1ABC, VP0, VP2, VP3, and VP1.

Figure 33A:
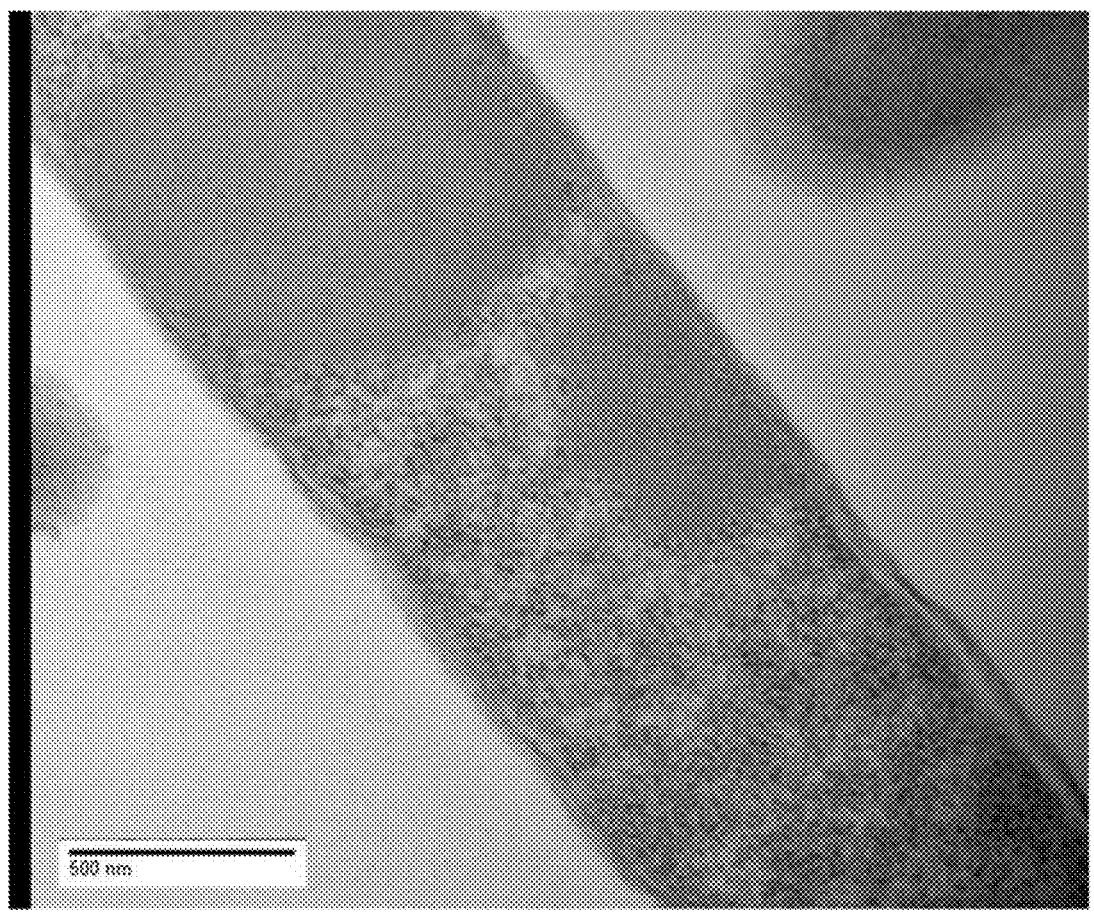
FIGS. 33A-B depict EM images of bacteria transformed with two plasmids simultaneously and producing VLP arrays.
Figure 33B:
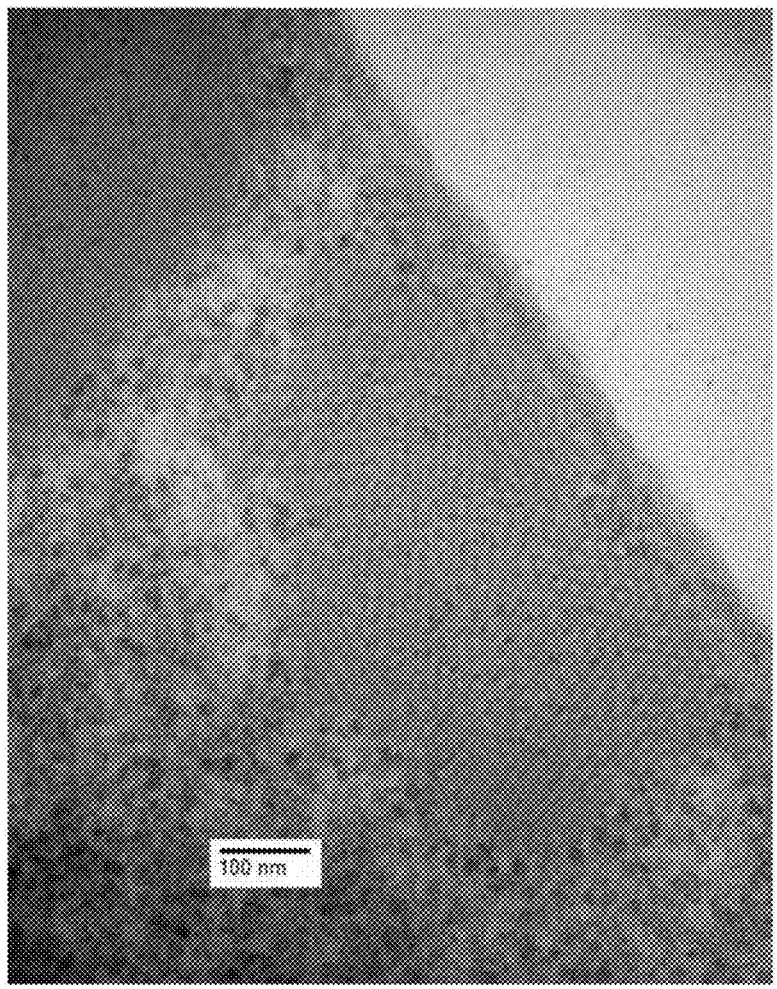

The presence of VP2 suggested that VLPs were forming. To evaluate this bacteria transformed with pET His-O1P1 and pSNAP Flag-3C(L127P) were evaluated by electron microscopy, FIGS. 33A-B. Examination of transformed bacteria by EM confirmed the presence of VLPs being produced. VLPs have immunogenic properties absent from individual virus proteins making them good candidates for a new FMDV vaccine.

Example 36: Expression and Processing of FMDV P1 Precursor Polypeptide in SF21 Cells Baculovirus vectors encoding O1P1 FMDV 3C protease (L127P) or FMDV 3C protease (L127P/C142T)-SGLuc were transformed into *Spodoptera frugiperda* SF21 cells. SF21 cells were cultured and supernatants were recovered, resolved by Western blotting, and probed with F14 (mouse monoclonal antibody to VP0/VP2), anti-VP3 rabbit polyclonal antibody, and 12FE9 (mouse monoclonal antibody to VP1). Both the L127P and L127P/C142T 3C protease mutants exhibited proteolytic activity on FMDV P1 protein.

The FMDV VP0 protein is around 33 kDa in molecular weight and VP2, VP3 and VP1 each have a molecular weight of about 24 kDa.

As apparent from the F14 (anti-VP0/VP2) Western blots in FIG. 34, VP0 was processed into smaller about 24 kDa subunits. The anti-VP3 Western blots in FIG. 34 show banding at about 24 kDa which is consistent with processing and cleavage of VP3 from the longer P1 precursor polypeptide. The 12FE9 (anti-VP1) Western blots in FIG. 34 show discrete bands above 28 kDa which is slightly more than the approximate molecular 24 kDa molecular weight of VP1.

Example 37: 3C(L127P)-SGLuc Chimeras Containing the P1 Polypeptide Precursor from Various FMDV Serotypes Constructs containing the P1 polypeptide precursor derived from five different FMDV serotypes-O1 Manisa (SEQ ID NO: 136), A24 Cruzeiro (SEQ ID NO: 138), Asia1 Shamir (SEQ ID NO: 144), C3 Indrial (SEQ ID NO: 141), and SAT2 Egypt (SEQ ID NO: 140), each followed by a nucleotide sequence encoding for a modified 3C protease at L127P (SEQ ID NO: 141) with a C-terminal Δ1D2A sequence fused to it, followed by SGLuc, were constructed.

These five constructs were evaluated on the ability of the FMDV 3C proteases modified at L127P to process the P1 polypeptide precursor in vivo (within the HEK293-T cells). To accomplish this, transfected HEK293-T cell lysates were run on protein gels for western blots to detect fully processed viral capsid proteins VP1-VP4 (see FIGS. 35A-D) utilizing the F14 (anti-VP0/2), anti-VP3, 6HC4 (anti-VP1), and 12FE9 (anti-VP1) antibodies.

The FMDV VP0 protein is around 33 kDa in molecular weight and VP2, VP3 and VP1 each have a molecular weight of about 24 kDa.

Figure 35A:
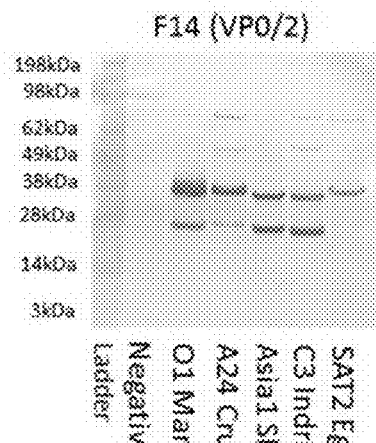
FIGS. 35A-D compare Western blots of HEK-293-T cells expressing one of five P1-3C(L127P)-SGLuc constructs wherein each respective P1 component was derived from one of FMDV serotypes O1 Manisa (SEQ ID NO: 136), A24 Cruzeiro (SEQ ID NO: 138), Asia1 Shamir (SEQ ID NO: 144), C3 Indrial (SEQ ID NO: 141), and SAT2 Egypt (SEQ ID NO: 140), in order to examine the ability of the L127P 3C mutant protease (SEQ ID NO: 39) to process and cleave each of the P1 polypeptide protein precursor derived from one of the aforementioned FMDV serotypes.
Figure 35B:
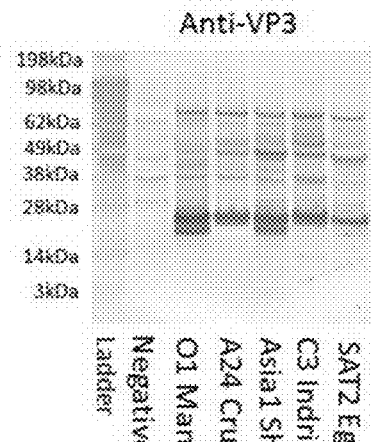
Figure 35C:
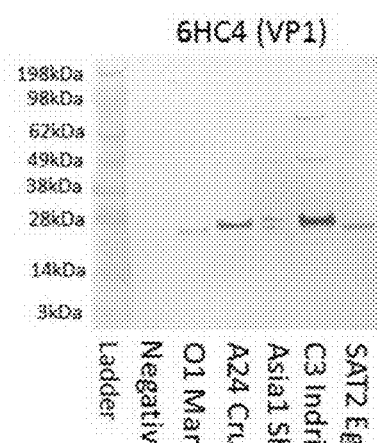
Figure 35D:
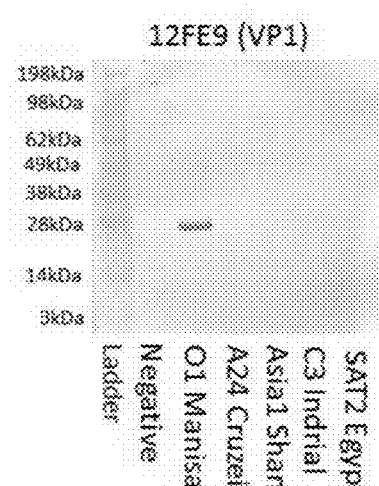

As apparent from the F14 (anti-VP0/VP2) Western blots in FIG. 35A, VP0 was processed into smaller 24 kDa subunits. The anti-VP3 Western blots in FIG. 35B show banding at about 24 kDa which is consistent with processing and cleavage of VP3 from the longer P1 precursor polypeptide. The 6HC4 (anti-VP1) Western blots in FIG. 35C show banding that are slightly below 28 kDa, and around the 24 kDa molecular weight of VP1. The 12FE9 (anti-VP1) Western blot in FIG. 35D shows a band for the lysates of the HEK293-T cells transfected with the O1P1-3C(L127P)-SGLuc that is slightly below 28 kDa which is around the 24 kDa molecular weight of VP1.

The Western blot samples show that the 3C(L127P) mutant retains proteolytic activity towards the P1 polypeptide precursor among the five different FMDV serotypes, based on the bands indicating VP2, VP3 and VP1 presence as shown specifically in FIGS. 35A-D.

Figures 36A, 36B:
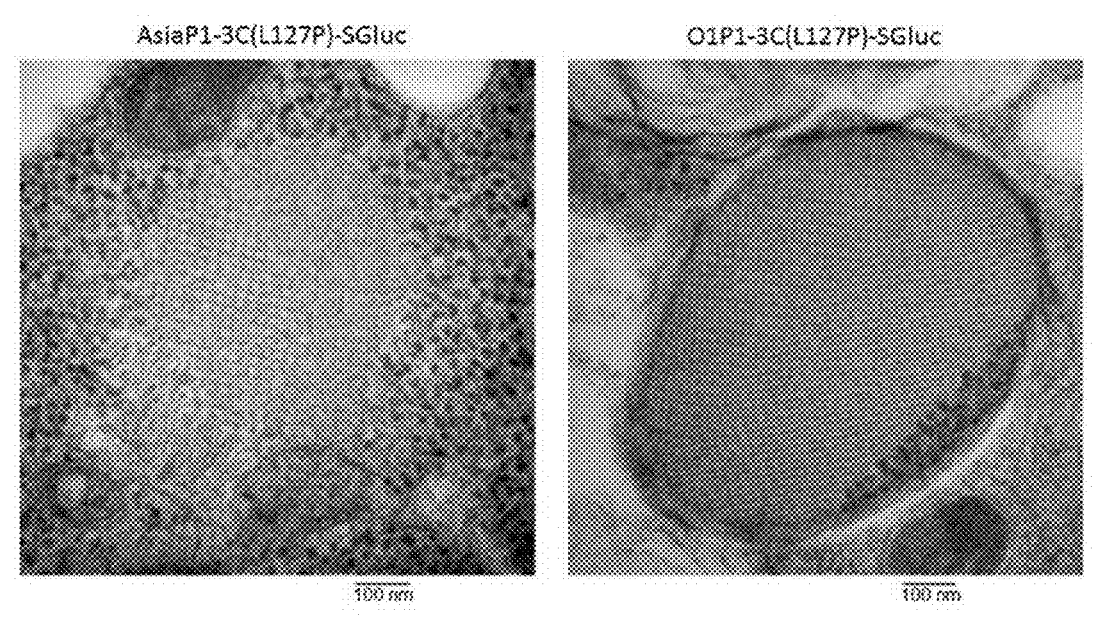

Example 38: Evaluation of VLP Formation of mpTarget-AsiaP1-3C(L127P)-SGLuc Construct Processing of the P1 polypeptide does not guarantee the formation of VLPs. To assess the retention of Asia P1 containing constructs to form VLPs, transfected cell cultures were examined using electron microscopy. In FIG. 36A, VLP arrays show that an Asia P1 processed by 3C(L127P) retains the ability to form VLPs.

The foregoing discussion discloses embodiments in accordance with the present disclosure. As will be understood by those skilled in the art, the approaches, methods, techniques, materials, devices, and so forth disclosed herein may be embodied in additional embodiments as understood

SEQUENCE LISTING (220 sequences)

SEQ ID NO: 1 - DNA, 639 bp, Foot-and-mouth disease virus
  CDS (1)..(639): Asia Lebanon 89
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 2 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 3 - DNA, 639 bp, Foot-and-mouth disease virus
  CDS (1)..(639): O1 Manissa Isolate 87
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 4 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 5 - DNA, 639 bp, Foot-and-mouth disease virus
  CDS (1)..(639): O1 pan Asia
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 6 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 7 - DNA, 639 bp, Foot-and-mouth disease virus
  CDS (1)..(639): A24 Cruzeiro iso71
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggagactgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 8 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 9 - DNA, 639 bp, Foot-and-mouth disease virus
  CDS (1)..(639): A Turkey 2006
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 10 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 11 - DNA, 639 bp, Foot-and-mouth disease virus
  CDS (1)..(639): SAT2 Egypt 2010
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 12 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 13 - DNA, 639 bp, Foot-and-mouth disease virus
  CDS (1)..(639): C3 indaial
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 14 - protein, 213 aa, Foot-and-mouth disease virus; identical to SEQ ID NO: 4

SEQ ID NO: 15 - DNA, 639 bp, Foot-and-mouth disease virus
  CDS (1)..(639): SAT3 ZIM/6/91
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 16 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 17 - DNA, 639 bp, Foot-and-mouth disease virus
  CDS (1)..(639): SAT1-20 iso11
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 18 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 19 - DNA, 639 bp, Foot-and-mouth disease virus
  CDS (1)..(639): Asia1 Shamir
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 20 - protein, 213 aa, Foot-and-mouth disease virus; identical to SEQ ID NO: 2

SEQ ID NO: 21 - DNA, 639 bp, Foot-and-mouth disease virus
  CDS (1)..(639)
  misc_feature (1)..(639): L127P Asia Lebanon 89
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 22 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 23 - DNA, 639 bp, Foot-and-mouth disease virus
  CDS (1)..(639)
  misc_feature (1)..(639): L127P O1 Manisa Isolate 87
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagaccgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 24 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 25 - DNA, 639 bp, Foot-and-mouth disease virus
  CDS (1)..(639)
  misc_feature (1)..(639): L127P O1 pan Asia
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagaccgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 26 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRPIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 27 - DNA, 639 bp, Foot-and-mouth disease virus
  CDS (1)..(639)
  misc_feature (1)..(639): L127P A24 Cruzeiro iso71
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggagaccgattttctctggtgaagcccttacctacaaggacattgtagtgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 28 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYKAATKAGYCGGAVLAKDGADTFIVGTHSAGGNGVGYCSCVSRSMLLKMKAHVDPEPHHE

SEQ ID NO: 29 - DNA, 639 bp, Foot-and-mouth disease virus
  CDS (1)..(639)
  misc_feature (1)..(639): L127P A Turkey/2006
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagaccgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 30 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 31 - DNA, 639 bp, Foot-and-mouth disease virus
  CDS (1)..(639)
  misc_feature (1)..(639): L127P SAT2 Egypt 2010
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagacccatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 32 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRPIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 33 - DNA, 639 bp, Foot-and-mouth disease virus
  CDS (1)..(639)
  misc_feature (1)..(639): L127P C3 indaial
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagaccgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 34 - protein, 213 aa, Foot-and-mouth disease virus; identical to SEQ ID NO: 24

SEQ ID NO: 35 - DNA, 639 bp, Foot-and-mouth disease virus
  CDS (1)..(639)
  misc_feature (1)..(639): L127P SAT3 ZIM/6/91
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagacccatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 36 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 37 - DNA, 639 bp, Foot-and-mouth disease virus
  CDS (1)..(639)
  misc_feature (1)..(639): L127P SAT1-20 iso11
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagacccatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 38 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRPIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 39 - DNA, 639 bp, Foot-and-mouth disease virus; identical to SEQ ID NO: 21
  CDS (1)..(639)
  misc_feature (1)..(639): L127P Asia1 Shamir

SEQ ID NO: 40 - protein, 213 aa, Foot-and-mouth disease virus; identical to SEQ ID NO: 22

SEQ ID NO: 41 - DNA, 639 bp, Foot-and-mouth disease virus
  CDS (1)..(639)
  misc_feature (1)..(639): V28K Asia Lebanon 89
agtggtgccccaccgaccgacttgcaaaagatggtcatgagcaacactaagcctgttgagctcatccttgacggtaagacgaaggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 42 - protein, 213 aa, Foot-and-mouth disease virus
SGAPPTDLQKMVMSNTKPVELILDGKTKAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 43 - DNA, 639 bp, Foot-and-mouth disease virus
  CDS (1)..(639)
  misc_feature (1)..(639): V28K O1 Manisa Isolate 87
agtggtgccccaccgaccgacttgcagaagatggtcatgggcaacactaagcctgttgagctcatcctcgacgggaagacgaaagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagactgattttctctggagaggcccttacctacaaagacattgtagtgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 44 - protein, 213 aa, Foot-and-mouth disease virus
SGAPPTDLQKMVMGNTKPVELILDGKTKAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGADTFIVGTHSAGGNGVGYCSCVSRSMLLKMKAHIDPEPHHE

SEQ ID NO: 45 - DNA, 639 bp, Foot-and-mouth disease virus
  CDS (1)..(639)
  misc_feature (1)..(639): V28K O1 pan Asia
agtggtgctccaccgactgacttgcaaaagatggtcatgggtaacaccaagcccgttgagctcatacttgacgggaagacaaaagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagactgattttctctggtgaggccctcacctacaaggacattgtagtgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 46 - protein, 213 aa, Foot-and-mouth disease virus
SGAPPTDLQKMVMGNTKPVELILDGKTKAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRLIFSGEALTYKDIVVCMDGDTMPGLFAYKAATKAGYCGGAVLAKDGAETFIVGTHSAGGNGVGYCSCVSRSMLLKMKAHIDPEPHHE

SEQ ID NO: 47 - DNA, 639 bp, Foot-and-mouth disease virus; identical to SEQ ID NO: 7
  CDS (1)..(639)
  misc_feature (1)..(639): V28K A24 Cruzeiro iso71

SEQ ID NO: 48 - protein, 213 aa, Foot-and-mouth disease virus; identical to SEQ ID NO: 8

SEQ ID NO: 49 - DNA, 639 bp, Foot-and-mouth disease virus
  CDS (1)..(639)
  misc_feature (1)..(639): V28K A Turkey/2006
agtggtgcccccccgaccgacttgcaaaagatggtcatgggcaacaccaagcctgttgagctcatcctcgacgggaagacgaaagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagactgattttctctggtgaggcccttacctacaaggacattgtagtgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 50 - protein, 213 aa, Foot-and-mouth disease virus
SGAPPTDLQKMVMGNTKPVELILDGKTKAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYCGGAVLAKDGAETFIVGTHSAGGNGVGYCSCVSRSMLLKMKAHIDPEPHHE

SEQ ID NO: 51 - DNA, 639 bp, Foot-and-mouth disease virus
  CDS (1)..(639)
  misc_feature (1)..(639): V28K SAT2 Egypt 2010
agtggagcgccacccaccgacttgcaaaagatggtgatggccaacaccaaaccagtcgagctcatactcgatggtaagacaaaggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagactcatcttctctggagaggcactcacctacaaagacattgtagtgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 52 - protein, 213 aa, Foot-and-mouth disease virus
SGAPPTDLQKMVMANTKPVELILDGKTKAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRLIFSGEALTYKDIVVCMDGDTMPGLFAYKAATKAGYCGGAVLAKDGAETFIVGTHSAGGNGVGYCSCVSKSMLLQMKAHIDPEPHHE

SEQ ID NO: 53 - DNA, 639 bp, Foot-and-mouth disease virus
  CDS (1)..(639)
  misc_feature (1)..(639): V28K C3 indaial
agcggtgccccaccgaccgacttgcaaaagatggtcatgggcaacaccaagcctgttgagctgattctcgatgggaagacgaaggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagactgattttctctggtgaggcccttacctacaaagacattgtggtgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 54 - protein, 213 aa, Foot-and-mouth disease virus; identical to SEQ ID NO: 44

SEQ ID NO: 55 - DNA, 639 bp, Foot-and-mouth disease virus
  CDS (1)..(639)
  misc_feature (1)..(639): V28K SAT3 ZIM/6/91
agcggatgcccaccgaccgacttgcaaaagatggtcatggcaaacgtaaagcctgttgagctcatcctcgacgggaagaccaaagcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagactcatcttctcaggagacgcactgacctacaaagacctggtcgtttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 56 - protein, 213 aa, Foot-and-mouth disease virus
SGCPPTDLQKMVMANVKPVELILDGKTKALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 57 - DNA, 639 bp, Foot-and-mouth disease virus
  CDS (1)..(639)
  misc_feature (1)..(639): V28K SAT1-20 iso11
agcggatgtccaccgaccgacctgcagaggatggtcatggcaaacgtgaaacccgttgagctcatcctcgatgggaagaccaaagcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagactcatcttctcaggagacgcactgacctacaaagacctggtcgtttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 58 - protein, 213 aa, Foot-and-mouth disease virus
SGCPPTDLQRMVMANVKPVELILDGKTKALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVVCMDGDTMPGLFAYRAGTKVGYCGAAVLAKDGAKTVIVGTHSAGGNGVGYCSCVSRSMLLQMKAHIDPAPHTE

SEQ ID NO: 59 - DNA, 639 bp, Foot-and-mouth disease virus
  CDS (1)..(639)
  misc_feature (1)..(639): V28K Asia1 Shamir
agtggtgccccaccgaccgacttgcaaaagatggtcatgagcaacactaagcctgttgagctcatccttgacggtaagacgaaggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagattgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 60 - protein, 213 aa, Foot-and-mouth disease virus; identical to SEQ ID NO: 42

SEQ ID NO: 61 - DNA, 639 bp, Foot-and-mouth disease virus
  CDS (1)..(639)
  misc_feature (1)..(639): V141T Asia Lebanon 89
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtaacgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 62 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRLIFSGEALTYKDIVTCMDGDTMPGLFAYRAATKAGYCGGAVLAKDGADTFIVGTHSAGGNGVGYCSCVSRSMLLKMKAHIDPEPHHE

SEQ ID NO: 63 - DNA, 639 bp, Foot-and-mouth disease virus
  CDS (1)..(639)
  misc_feature (1)..(639): V141T O1 Manisa Isolate 87
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagactgattttctctggagaggcccttacctacaaagacattgtaacgtgcatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 64 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVTCMDGDTMPGLFAYRAATKAGYCGGAVLAKDGADTFIVGTHSAGGNGVGYCSCVSRSMLLKMKAHIDPEPHHE

SEQ ID NO: 65 - DNA, 639 bp, Foot-and-mouth disease virus
  CDS (1)..(639)
  misc_feature (1)..(639): V141T O1 pan Asia
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagactgattttctctggtgaggccctcacctacaaggacattgtaacgtgcatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 66 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRLIFSGEALTYKDIVTCMDGDTMPGLFAYKAATKAGYCGGAVLAKDGAETFIVGTHSAGGNGVGYCSCVSRSMLLKMKAHIDPEPHHE

SEQ ID NO: 67 - DNA, 639 bp, Foot-and-mouth disease virus
  CDS (1)..(639)
  misc_feature (1)..(639): V141T A24 Cruzeiro iso71
agtggtgccccaccgaccgacttgcaaaagttggtcatgggcaacaccaagcccgttgagctcatccttgacgggaagacggtagccatttgctgtgctactggagttttcggcactgcttacctcgtgcctcgtcatcttttcgcagaaaagtacgacaagatcatgttggacggcagagccatgacagatagtgactacagagtgtttgagtttgagattaaagtaaaaggacaggacatgctctcagacgctgcgctcatggtgctccaccgtgggaatcgcgtgagagacatcacgaaacactttcgtgacacagcaagaatgaagaaaggcacccccgtcgttggtgtgatcaacaacgccgatgtcgggagactgattttctctggtgaagcccttacctacaaggacattgtaacgtgcatggatggagacaccatgcctgggctctttgcctacaaagccgcaaccaaggctggttattgcggaggagccgtcctcgctaaggacggggctgacacgttcatcgttggcacccactccgctggaggcaatggcgttggatactgctcttgcgtttccaggtccatgcttctcaagatgaaggcacacgttgaccccgaaccacaccacgag

SEQ ID NO: 68 - protein, 213 aa, Foot-and-mouth disease virus
SGAPPTDLQKLVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVTCMDGDTMPGLFAYKAATKAGYCGGAVLAKDGADTFIVGTHSAGGNGVGYCSCVSRSMLLKMKAHVDPEPHHE

SEQ ID NO: 69 - DNA, 639 bp, Foot-and-mouth disease virus
  CDS (1)..(639)
  misc_feature (1)..(639): V141T A Turkey/2006
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagactgattttctctggtgaggcccttacctacaaggacattgtaacgtgcatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 70 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRLIFSGEALTYKDIVTCMDGDTMPGLFAYRAATKAGYCGGAVLAKDGAETFIVGTHSAGGNGVGYCSCVSRSMLLKMKAHIDPEPHHE

SEQ ID NO: 71 - DNA, 639 bp, Foot-and-mouth disease virus
  CDS (1)..(639)
  misc_feature (1)..(639): V141T SAT2 Egypt 2010
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagactcatcttctctggagaggcactcacctacaaagacattgtaacgtgtatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 72 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRLIFSGEALTYKDIVTCMDGDTMPGLFAYKAATKAGYCGGAVLAKDGAETFIVGTHSAGGNGVGYCSCVSKSMLLQMKAHIDPEPHHE

SEQ ID NO: 73 - DNA, 639 bp, Foot-and-mouth disease virus
  CDS (1)..(639)
  misc_feature (1)..(639): V141T C3 indaial
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagactgattttctctggtgaggcccttacctacaaagacattgtgacgtgcatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 74 - protein, 213 aa, Foot-and-mouth disease virus; identical to SEQ ID NO: 64

SEQ ID NO: 75 - DNA, 639 bp, Foot-and-mouth disease virus
  CDS (1)..(639)
  misc_feature (1)..(639): V141T SAT3 ZIM/6/91
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagactcatcttctcaggagacgcactgacctacaaagacctggtcacttgtatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 76 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVTCMDGDTMPGLFAYRAGTKVGYCGAAVLAKDGAKTVIVGTHSAGGNGVGYCSCVSRSMLLQMKAHIDPAPHTE

SEQ ID NO: 77 - DNA, 639 bp, Foot-and-mouth disease virus
  CDS (1)..(639)
  misc_feature (1)..(639): V141T SAT1-20 iso11
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagactcatcttctcaggagacgcactgacctacaaagacctggtcacttgtatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 78 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRLIFSGDALTYKDLVTCMDGDTMPGLFAYRAGTKVGYCGAAVLAKDGAKTVIVGTHSAGGNGVGYCSCVSRSMLLQMKAHIDPAPHTE

SEQ ID NO: 79 - DNA, 639 bp, Foot-and-mouth disease virus
  CDS (1)..(639)
  misc_feature (1)..(639): V141T Asia1 Shamir
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagattgattttctccggtgaggccctcacctacaaggacattgtaacgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 80 - protein, 213 aa, Foot-and-mouth disease virus; identical to SEQ ID NO: 62

SEQ ID NO: 81 - DNA, 639 bp, Foot-and-mouth disease virus
  CDS (1)..(639)
  misc_feature (1)..(639): L127P/C142T Asia Lebanon 89
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgaccatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 82 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRPIFSGEALTYKDIVVTMDGDTMPGLFAYRAATKAGYCGGAVLAKDGADTFIVGTHSAGGNGVGYCSCVSRSMLLKMKAHIDPEPHHE

SEQ ID NO: 83 - DNA, 639 bp, Foot-and-mouth disease virus
  CDS (1)..(639)
  misc_feature (1)..(639): L127P/C142T O1 Manissa Iso87
agtggtgccccaccgaccgacttgcagaagatggtcatgggcaacactaagcctgttgagctcatcctcgacgggaagacggtagccatctgctgtgctaccggagtgtttggcactgcctacctcgtacctcgtcacctcttcgcggagaagtacgacaagataatgttggacggtagagccatgacagacagtgactacagagtgtttgagtttgagattaaagtaaaaggacaggacatgctctcagacgctgcactcatggtgcttcaccgtgggaaccgcgtgagagacatcacgaaacattttcgtgacacagcaagaatgaagaaaggcacccccgttgtcggtgtgatcaacaacgccgacgttgggagaccgattttctctggagaggcccttacctacaaagacattgtagtgaccatggatggagacaccatgccgggcctgtttgcctacagagccgccaccaaggctggttactgcgggggagccgttctcgccaaggacggagccgacacattcatcgttggcactcactccgcaggtggtaacggagttggatactgctcgtgcgtgtccaggtccatgctcctgaaaatgaaggcacacattgaccctgaaccacaccacgag

SEQ ID NO: 84 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVTMDGDTMPGLFAYRAATKAGYCGGAVLAKDGADTFIVGTHSAGGNGVGYCSCVSRSMLLKMKAHIDPEPHHE

SEQ ID NO: 85 - DNA, 639 bp, Foot-and-mouth disease virus
  CDS (1)..(639)
  misc_feature (1)..(639): L127P/C142T O1 pan Asia
agtggtgctccaccgactgacttgcaaaagatggtcatgggtaacaccaagcccgttgagctcatacttgacgggaagacagtagccatctgctgtgctactggagtgtttggcaccgcctacctcgtgcctcgtcatcttttcgcagagaagtatgacaagatcatgttggacggcagagccatgacagacagtgactacagagtgtttgagtttgagattaaagtaaaaggacaggacatgctctcagacgccgcgctcatggtgctccaccgtgggaatcgcgtgcgggacatcacgaaacacttccgtgatgtggcaagaatgaagaaaggaacccccgtcgttggtgttatcaacaacgccgatgtcgggagaccgattttctctggtgaggccctcacctacaaggacattgtagtgaccatggatggagacaccatgcctggcctctttgcctacaaggccgccaccaaggccggctactgtggaggagccgttctcgcaaaggacggagccgagactttcatcgtcggcacacactctgcgggcggcaacggagttggatactgctcctgcgtgtccaggtccatgctgctcaagatgaaggcacacatagatcctgaaccacaccatgaa

SEQ ID NO: 86 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDVARMKKGTPVVGVINNADVGRPIFSGEALTYKDIVVTMDGDTMPGLFAYKAATKAGYCGGAVLAKDGAETFIVGTHSAGGNGVGYCSCVSRSMLLKMKAHIDPEPHHE

SEQ ID NO: 87 - DNA, 639 bp, Foot-and-mouth disease virus; identical to SEQ ID NO: 85
  CDS (1)..(639)
  misc_feature (1)..(639): L127P/C142T A24 Cruzeiro iso71

SEQ ID NO: 88 - protein, 213 aa, Foot-and-mouth disease virus; identical to SEQ ID NO: 86

SEQ ID NO: 89 - DNA, 639 bp, Foot-and-mouth disease virus
  CDS (1)..(639)
  misc_feature (1)..(639): L127P/C142T A Turkey/2006
agtggtgcccccccgaccgacttgcaaaagatggtcatgggcaacaccaagcctgttgagctcatcctcgacgggaagacggtagccatctgttgcgctaccggagtgtttggcactgcttaccttgtgccacgtcatcttttcgcggagaagtatgacaagatcatgctggacggcagagccatgacagacagtgactacagagtgtttgagtttgagattaaagtaaaagggcaggacatgctctcagatgccgcgctcatggtgctccaccgtgggaatcgcgtgagagacatcacgaaacactttcgtgatacagcaagaatgaagaagggcacccccgttgtcggtgttatcaacaacgctgatgtcgggagaccgattttctctggtgaggcccttacctacaaggacattgtagtgaccatggatggagacaccatgcctggcctctttgcctacagagccgccaccaaggctggctattgtggaggagctgttcttgcaaaggacggagccgagaccttcatcgtcggcactcactccgcaggtggtaatggagttggatactgttcatgcgtttccaggtccatgctgctaaagatgaaggcacacatcgaccctgagccacaccacgag

SEQ ID NO: 90 - protein, 213 aa, Foot-and-mouth disease virus
SGAPPTDLQKMVMGNTKPVELILDGKTVAICCATGVFGTAYLVPRHLFAEKYDKIMLDGRAMTDSDYRVFEFEIKVKGQDMLSDAALMVLHRGNRVRDITKHFRDTARMKKGTPVVGVINNADVGRPIFSGEALTYKDIVVTMDGDTMPGLFAYRAATKAGYCGGAVLAKDGAETFIVGTHSAGGNGVGYCSCVSRSMLLKMKAHIDPEPHHE

SEQ ID NO: 91 - DNA, 639 bp, Foot-and-mouth disease virus
  CDS (1)..(639)
  misc_feature (1)..(639): L127P/C142T SAT2 Egypt 2010
agtggagcgccacccaccgacttgcaaaagatggtgatggccaacaccaaaccagtcgagctcatactcgatggtaagacagtggcgatctgctgtgccactggagtgtttgggactgcctatctcgtgcctcgtcatcttttcgctgagaagtatgacaagatcatgattgacggcagggccatgacagaccgtgatttcagagtgtttgagtttgagattaaagtaaaaggacaggacatgctctcggacgccgccctcatggtgctgcaccgtgggaaccgcgtgagagacatcacgaagcactttcgtgatcaagcaagaatgagaaaaggaacccccgtggttggcgtgatcaacaacgccgacgttgggagacccatcttctctggagaggcactcacctacaaagacattgtagtgactatggatggcgacaccatgccaggcctctttgcctataaagccgccaccaaagctggctactgtggaggagccgttcttgcgaaagacggagccgagactttcatcgtcggcactcactccgctggaggaaacggagttggttactgctcttgcgtttccaagtccatgctcctgcaaatgaaggcacacattgatcctgaaccacaccacgaa

SEQ ID NO: 92 - protein, 213 aa, Foot-and-mouth disease virus
SGAPPTDLQKMVMANTKPVELILDGKTVAICCATGVFGTAYLVPRHLFAEKYDKIMIDGRAMTDRDFRVFEFEIKVKGQDMLSDAALMVLHRGNRVRDITKHFRDQARMRKGTPVVGVINNADVGRPIFSGEALTYKDIVVTMDGDTMPGLFAYKAATKAGYCGGAVLAKDGAETFIVGTHSAGGNGVGYCSCVSKSMLLQMKAHIDPEPHHE

SEQ ID NO: 93 - DNA, 639 bp, Foot-and-mouth disease virus
  CDS (1)..(639)
  misc_feature (1)..(639): L127P/C142T C3 indaial
agcggtgccccaccgaccgacttgcaaaagatggtcatgggcaacaccaagcctgttgagctgattctcgatgggaagacggtggccatctgctgcgccaccggagtgtttggcactgcttacctcgtgccgcgtcatcttttcgcagagaagtatgacaagatcatgttggacggcagagccatgacagacagtgactacagagtgtttgagtttgagattaaagtaaaaggacaggacatgctctcggacgccgcactcatggtgctacaccgtgggaatcgcgtgagagacatcacgaagcactttcgtgacacagcaagaatgaagaaaggcacccccgtcgtaggcgtgattaacaacgccgacgttgggagaccgattttctctggtgaggcccttacctacaaagacattgtggtgaccatggatggagacaccatgcctggcctctttgcctacagagccgccaccaaggctggttactgtggaggagccgtccttgccaaggatggagctgacacattcatcgtcggcactcactctgctggaggcaatggagttggttactgctcatgcgtttccagatccatgcttctcaagatgaaggcacacattgaccctgagccacaccacgag

SEQ ID NO: 94 - protein, 213 aa, Foot-and-mouth disease virus; identical to SEQ ID NO: 84

SEQ ID NO: 95 - DNA, 639 bp, Foot-and-mouth disease virus
  CDS (1)..(639)
  misc_feature (1)..(639): L127P/C142T SAT3 ZIM/6/91
agcggatgcccaccgaccgacttgcaaaagatggtcatggcaaacgtaaagcctgttgagctcatcctcgacgggaagaccgttgcgctctgctgcgcgacgggagtgtttgggacagcttacctcgtgccccgtcatcttttcgcagagaagtatgacaagatcatgctggacggccgcgccctgacagacagtgactttagagtgtttgagtttgaggtgaaagtaaaaggacaggacatgctctctgatgccgcactcatggttctccactctggaaaccgtgtgcgcgatctcacgggacacttccgtgacaccatgaaactgtcgaaaggcagccccgtcgttggtgttgtcaacaacgctgatgtcggaagacccatcttctcaggagacgcactgacctacaaagacctggtcgttactatggacggtgataccatgcctggactcttcgcttaccgcgcagggaccaaggttggatactgcggagctgccgttctcgcaaaggacggcgccaagactgtgatcgttggcacccactcagccggaggcaacggagtgggctactgctcctgcgtctcacgatccatgctcctgcagatgaaggcccacattgatccggctcctcacaccgag

SEQ ID NO: 96 - protein, 213 aa, Foot-and-mouth disease virus
SGCPPTDLQKMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRPIFSGDALTYKDLVVTMDGDTMPGLFAYRAGTKVGYCGAAVLAKDGAKTVIVGTHSAGGNGVGYCSCVSRSMLLQMKAHIDPAPHTE

SEQ ID NO: 97 - DNA, 639 bp, Foot-and-mouth disease virus
  CDS (1)..(639)
  misc_feature (1)..(639): L127P/C142T SAT1-20 iso11
agcggatgtccaccgaccgacctgcagaggatggtcatggcaaacgtgaaacccgttgagctcatcctcgatgggaagaccgttgcgctctgctgcgctacgggagtgttcgggacggcttatctcgtgcctcgtcatcttttcgcagagaagtacgacaagatcatgctggacggccgtgccctgacagacagtgacttcagagtgtttgagtttgaggtgaaagtaaaaggacaggacatgctctcagatgccgcgctcatggttctccactccggaaaccgtgtgcgcgatctcacgggacacttccgtgacacaatgaaactgtcgaaaggcagtcccgtcgttggtgtggtcaacaacgccgacgtcggaagacccatcttctcaggagacgcactgacctacaaagacctggtcgttactatggacggtgacaccatgcccggactcttcgcataccgcgcggggaccaaggttggttattgtggagcagccgttcttgcaaaagacggcgccaagactgtgatcgtcggcacccactcagccggtggcaacggagtaggctactgctcctgtgtctcacgatccatgctcctgcagatgaaagcccacatcgacccggccccccacaccgag

SEQ ID NO: 98 - protein, 213 aa, Foot-and-mouth disease virus
SGCPPTDLQRMVMANVKPVELILDGKTVALCCATGVFGTAYLVPRHLFAEKYDKIMLDGRALTDSDFRVFEFEVKVKGQDMLSDAALMVLHSGNRVRDLTGHFRDTMKLSKGSPVVGVVNNADVGRPIFSGDALTYKDLVVTMDGDTMPGLFAYRAGTKVGYCGAAVLAKDGAKTVIVGTHSAGGNGVGYCSCVSRSMLLQMKAHIDPAPHTE

SEQ ID NO: 99 - DNA, 639 bp, Foot-and-mouth disease virus; identical to SEQ ID NO: 81
  CDS (1)..(639)
  misc_feature (1)..(639): L127P/C142T Asia1 Shamir

SEQ ID NO: 100 - protein, 213 aa, Foot-and-mouth disease virus; identical to SEQ ID NO: 82

SEQ ID NO: 101 - DNA, 2259 bp, Foot-and-mouth disease virus
  CDS (1)..(2259)
  misc_feature (1)..(2259): O1 Manisa Iso87;  P1; Accession: AY593823
ggagccgggcaatccagcccggcaaccgggtcacagaaccaatcaggcaacactgggagcatcatcaacaattactacatgcagcagtaccaaaactccatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttctcgaggaccgcatcctcactactcgtaacggacacaccacctcgacaacccagtcgagcgttggagtcacgtacgggtatgcaacagctgaggatttcgtgagcgggccaaacacctctggtctcgagaccagggttgcccaggcagagcggttctttaaaacccacctgttcgactgggtcaccagtgacccgttcggacggtgccacctgctggaacttccaactgaccacaaaggtgtctacggcagcctgaccgactcgtatgcttatatgaggaacggctgggatgttgaagtcactgcagtgggaaaccagttcaatggaggatgcctgttggtggccatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgaccactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtcgaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcattcatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggctagcgccggaaaggactttgagctgcgcctgccggtggatgctcgcacacagactacctccgcgggcgagtcagctgaccccgtgaccgccaccgttgagaattacggtggcgagacacaggtccagaggcgccaacacacggacgtctcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtcccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgacctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggcaccggtgaaacagcttctaaattttgacctgctcaaattggcgggagatgtggagtccaaccctgggccc

SEQ ID NO: 102 - protein, 753 aa, Foot-and-mouth disease virus
GAGQSSPATGSQNQSGNTGSIINNYYMQQYQNSMDTQLGDNATSGGSNEGSTDTTSTHTTNTQNNDWFSKLASSAFSGLFGALLADKKTEETTLLEDRILTTRNGHTTSTTQSSVGVTYGYATAEDFVSGPNTSGLETRVAQAERFFKTHLFDWVTSDPFGRCHLLELPTDHKGVYGSLTDSYAYMRNGWDVEVTAVGNQFNGGCLLVAMVPELCSIQKRELYQLTLFPHQFINPRTNMTAHITVPFVGVNRYDQYKVHKPWTLVVMVVAPLTVNSEGAPQIKVYANIAPTNVHVAGEFPSKEGIFPVACSDGYGGLVTTDPKTADPAYGKVFNPPRNMLPGRFTNFLDVAEACPTFLHFEGDVPYVTTKTDSDRVLAQFDLSLAAKHMSNTFLAGLAQYYTQYSGTINLHFMFTGPTDAKARYMIAYAPPGMEPPKTPEAAAHCIHAEWDTGLNSKFTFSIPYLSAADYAYTASDTAETTNVQGWVCLFQITHGKADGDALVVLASAGKDFELRLPVDARTQTTSAGESADPVTATVENYGGETQVQRRQHTDVSFILDRFVKVTPKDQINVLDLMQTPAHTLVGALLRTATYYFADLEVAVKHEGNLTWVPNGAPEAALDNTTNPTAYHKAPLTRLALPYTAPHRVLATVYNGNSKYGDGTVANVRGDLQVLAQKAARALPTSFNYGAIKATRVTELLYRMKRAETYCPRPLLAIHPDQARHKQKIVAPVKQLLNFDLLKLAGDVESNPGP

SEQ ID NO: 103 - DNA, 2259 bp, Foot-and-mouth disease virus
  CDS (1)..(2259)
  misc_feature (1)..(2259): O1 pan Asia; P1
ggtgctgggcaatccagcccggcgactgggtcacagaaccagtcaggcaacactggaagcatcatcaacaactactacatgcagcagtaccagaactccatggacacacaacttggtgacaacgctatcagcggaggctctaacgaagggtctacagacaccacctccacccacacaaccaacactcagaacaacgactggttttcaaaactagccagttccgctttcagcggtcttttcggcgctcttctcgccgacaagaaaaccgaggagactactcttctcgaggaccgcatcctcactacccgtaacggacacacaacctcgacaacccagtcgagcgttggagtcacttacgggtacgcaacagccgaggattttgtgagcgggccaaacacatctggccttgagaccagggttgtgcaagcagagcggttcttcaaaacccacttgttcgattgggtcactagtgactcgttcggacgatgccacctgctggaacttccaactgaccacaaaggtgtctacggcagcctgactgattcttatgcgtacatgagaaacggttgggatgtcgaggtcactgcggtgggaaaccagttcaacggaggatgcctgttggtggccatggtgccagaactctgctctatcagcaaaagagagctgtaccagctcacgctctttccccaccagttcatcaacccccggacgaacatgacggcacacatcaccgtgccctttgtcggcgtcaaccgctacgaccagtacaaggtacacaaaccttggaccctcgtggtcatggtcgtggccccgctgactgtcaacactgaaggtgctccacagatcaaggtttatgccaacatcgcccctaccaacgtgcacgtcgcgggtgagttcccctccaaggaagggatcttccccgtggcctgcagtgacggttacggcggtcttgtgaccactgacccaaagacggctgaccccgtttacgggaaagttttcaatccccctcgcagcatgttgccagggcgattcaccaacttccttgatgtggctgaggcgtgccctacgtttctgcattttgagggtgacgtaccatacgtgaccacaaagacggattcggacagggttctcgctcagtttgacttgtctttggcagcgaagcacatgtcaaacacctttcttgcaggtctcgcccagtactacgcacagtacagtggcactattaacctgcacttcatgttcacagggcccactgacgcgaaagcgcgttacatgattgcatatgccccccccggcatggagccgcctaaaacacctgaggcagccgctcactgcattcacgcggagtgggatactggattgaattcaaaattcacattctcaatcccttacctctcggcggctgactacgcgtacaccgcgtctgacaccgccgagaccacaaatgtacagggatgggtttgcctgtttcaaatcacgcacgggaaggccgatggtgacgcacttgttgtcctggctagcgccggtaaggacttcgagctgcggttgccagttgatgcccgcacgcagaccacctccacaggtgagtcagctgaccccgtgactgccactgttgagaactacggtggcgaaacacaggtccagagacgccagcacacggacgtctcgtttatattggacagatttgtgaaagtgacaccaaaagaccaaatcaatgtgttggacctgatgcaaacccccgcccacactttggtaggtgcactcctccgcaccgccacctactacttcgcagatttagaggtggcagtaaaacacgaggggaaccttacctgggtcccgaatggggcgcccgagacagcgttggataacaccactaatccaacggcttaccacaaggcaccgctcactcgtcttgcactgccttacacggcaccgcaccgtgtcttggctaccgtttacaacgggaactgcaagtacgacgagagcagcacaaccaacgtgagaggtgacctgcaagtgttggcccaaaaggcggcgaggacgctgcccacctccttcaactacggtgccatcaaagctacccgggtgaacgagttgctttaccgcatgaagagggctgaaacatactgcccccggcctcttttggccattcatccgaatgaagcaagacacaagcaaaagatagtggcacctgcgaagcaactcctgaacttcgacctgctcaagttggcgggagacgttgagtccaaccctgggccc

SEQ ID NO: 104 - protein, 753 aa, Foot-and-mouth disease virus
GAGQSSPATGSQNQSGNTGSIINNYYMQQYQNSMDTQLGDNAISGGSNEGSTDTTSTHTTNTQNNDWFSKLASSAFSGLFGALLADKKTEETTLLEDRILTTRNGHTTSTTQSSVGVTYGYATAEDFVSGPNTSGLETRVVQAERFFKTHLFDWVTSDSFGRCHLLELPTDHKGVYGSLTDSYAYMRNGWDVEVTAVGNQFNGGCLLVAMVPELCSISKRELYQLTLFPHQFINPRTNMTAHITVPFVGVNRYDQYKVHKPWTLVVMVVAPLTVNTEGAPQIKVYANIAPTNVHVAGEFPSKEGIFPVACSDGYGGLVTTDPKTADPVYGKVFNPPRSMLPGRFTNFLDVAEACPTFLHFEGDVPYVTTKTDSDRVLAQFDLSLAAKHMSNTFLAGLAQYYAQYSGTINLHFMFTGPTDAKARYMIAYAPPGMEPPKTPEAAAHCIHAEWDTGLNSKFTFSIPYLSAADYAYTASDTAETTNVQGWVCLFQITHGKADGDALVVLASAGKDFELRLPVDARTQTTSTGESADPVTATVENYGGETQVQRRQHTDVSFILDRFVKVTPKDQINVLDLMQTPAHTLVGALLRTATYYFADLEVAVKHEGNLTWVPNGAPETALDNTTNPTAYHKAPLTRLALPYTAPHRVLATVYNGNCKYDESSTTNVRGDLQVLAQKAARTLPTSFNYGAIKATRVNELLYRMKRAETYCPRPLLAIHPNEARHKQKIVAPAKQLLNFDLLKLAGDVESNPGP

SEQ ID NO: 105 - DNA, 2262 bp, Foot-and-mouth disease virus
  CDS (1)..(2262)
  misc_feature (1)..(2262): A24 Cruzeiro iso71; P1; Accession: AY593768
ggggccgggcaatccagtccggcgaccggctcgcagaaccaatctggcaacactggcagcataattaacaactactacatgcagcaataccagaactccatggacacacagttgggagacaatgccatcagtggaggctccaacgagggctccacggacacaacttcaacacacacaaccaacactcaaaacaatgactggttctcgaagctcgccagttcagcttttaccggtctgttcggtgcactgctcgccgacaagaagacagaggaaacgacacttcttgaggaccgcatcctcaccacccgcaacgggcacaccacctcgacgacccaatcgagtgtgggtgtcacacacgggtactccacagaggaggaccacgttgctgggcccaacacatcgggcctggagacgcgagtggtgcaggcagagagattctacaaaaagtacttgtttgactggacaacggacaaggcatttggacacctggaaaagctggagctcccgtccgaccaccacggtgtctttggacacttggtggactcgtacgcctatatgagaaatggctgggatgttgaggtgtccgctgttggcaaccagttcaacggcgggtgcctcctggtggccatggtacctgaatggaaggaatttgacacacgggagaaataccaactcacccttttcccgcaccagtttattagccccagaactaacatgactgcccacatcacggtcccctaccttggtgtgaacaggtatgatcagtacaagaagcataagccctggacattggttgtcatggtcgtgtcgccacttacggtcaacaacactagtgcggcacaaatcaaggtctacgccaacatagctccgacctatgttcacgtggccggtgaactcccctcgaaagaggggattttcccggttgcatgtgcggacggttacggaggattggtgacgacagacccgaagacagctgaccctgcttatggcaaggtgtacaacccgcctaggactaactaccctgggcgcttcaccaacctgttggacgtggccgaagcgtgtcccactttcctctgctttgacgacgggaaaccgtacgtcaccacgcggacggatgacacccgacttttggccaagtttgacctttcccttgccgcaaaacatatgtccaacacatacctgtcagggattgctcagtactacacacagtactctggcaccatcaatttgcatttcatgttcacaggttccactgattcaaaggcccgatacatggtggcctacatcccacctggggtggagacaccaccggacacacctgaaagggctgcccactgcattcacgctgaatgggacactggactaaactccaaattcactttctcaatcccgtacgtatccgccgcggattacgcgtacacagcgtctgacacggcagaaacaatcaacgtacagggatgggtctgcatctaccaaattacacacgggaaggctgaaaatgacaccttggtcgtgtcggttagcgccggcaaagactttgagttgcgcctcccgattgacccccgccagcagaccaccgctaccggggaatcagcagacccggtcaccaccaccgtggagaactacggcggtgagacacaaatccagagacgtcaccacacggacattggtttcatcatggacagatttgtgaagatccaaagcttgagcccaacacatgtcattgacctcatgcagactcaccaacacggtctggtgggtgccttgctgcgtgcagccacgtactacttttctgacctggaaattgttgtacggcacgaaggcaatctgacctgggtgcccaacggcgcccctgaatcagccctgttgaacaccagcaaccccactgcctacaacaaggcaccattcacgagactcgctctcccctacactgcgccgcaccgtgtgctggcaacagtgtacaacgggacgagtaagtatgctgtgggtggttcaggcagaagaggcgacatggggtctctcgcggcgcgagtcgtgaaacagcttcctgcttcatttaactacggtgcaatcaaggccgacgccatccacgaacttctcgtgcgcatgaaacgggccgagctctactgccccagaccgctgttggcaatagaggtgtcttcgcaagacaggcacaagcaaaagatcattgcaccagcaaagcagcttctgaattttgacctgctcaagttggccggagacgttgagtccaaccctgggccc

SEQ ID NO: 106 - protein, 754 aa, Foot-and-mouth disease virus
GAGQSSPATGSQNQSGNTGSIINNYYMQQYQNSMDTQLGDNAISGGSNEGSTDTTSTHTTNTQNNDWFSKLASSAFTGLFGALLADKKTEETTLLEDRILTTRNGHTTSTTQSSVGVTHGYSTEEDHVAGPNTSGLETRVVQAERFYKKYLFDWTTDKAFGHLEKLELPSDHHGVFGHLVDSYAYMRNGWDVEVSAVGNQFNGGCLLVAMVPEWKEFDTREKYQLTLFPHQFISPRTNMTAHITVPYLGVNRYDQYKKHKPWTLVVMVVSPLTVNNTSAAQIKVYANIAPTYVHVAGELPSKEGIFPVACADGYGGLVTTDPKTADPAYGKVYNPPRTNYPGRFTNLLDVAEACPTFLCFDDGKPYVTTRTDDTRLLAKFDLSLAAKHMSNTYLSGIAQYYTQYSGTINLHFMFTGSTDSKARYMVAYIPPGVETPPDTPERAAHCIHAEWDTGLNSKFTFSIPYVSAADYAYTASDTAETINVQGWVCIYQITHGKAENDTLVVSVSAGKDFELRLPIDPRQQTTATGESADPVTTTVENYGGETQIQRRHHTDIGFIMDRFVKIQSLSPTHVIDLMQTHQHGLVGALLRAATYYFSDLEIVVRHEGNLTWVPNGAPESALLNTSNPTAYNKAPFTRLALPYTAPHRVLATVYNGTSKYAVGGSGRRGDMGSLAARVVKQLPASFNYGAIKADAIHELLVRMKRAELYCPRPLLAIEVSSQDRHKQKIIAPAKQLLNFDLLKLAGDVESNPGP

SEQ ID NO: 107 - DNA, 2262 bp, Foot-and-mouth disease virus
  CDS (1)..(2262)
  misc_feature (1)..(2262): A Turkey/2006; P1; Accession: JF749841
ggagccgggcaatccagtccggcaaccgggtcacaaaaccaatcaggcaacactggtagtatcatcaacaactactacatgcagcagtaccagaactccatggatacacaacttggcgacaacgccattagcggtggttccaacgagggctccactgacactacctccacacacacaaccaacacacagaacaatgactggttttcaaagctggccagttctgccttcagcggtctcttcggcgctcttctcgctgacaaaaagacagaggagactaccctcctggaggaccgcatccttaccacccgcaacggacacaccacctcgacaacccagtcgagtgtgggtgtcacctacgggtactccactggtgaagaccacgtctctggacctaacacatctggcctggagacgcgagtggtacaggcagagagattcttcaagaaacacttgtttgattggacaactgataaagcttttggacacctggaaaaactggaactccccaccgaacacaagggtgtctacgggcacttggtggactctttcgcatacatgagaaatggctgggacgtggaggtgaccgccgttggcaaccagttcaacggtgggtgtctcctggtggccatggtacctgagtggaaagagtttacccctcgtgagaaataccagctcaccctgtttccacaccaatttatcaaccccagaaccaacatgacagcccacatcacggtcccgtaccttggtgtcaataggtatgaccagtacaaacagcacaaaccctggacactggtcgtgatggtggtttcgccactgaccaccagcagcattggggcctcacagattaaggtctacgccaacattgccccaaccttcgttcacgtggccggcgagctcccatcgaaagaagggatcgtgccggttgcttgtacagacgggtacggtggcctggtgacaacagacccgaaaacagctgaccctgtttatggtatggtgtacaacccgcccagaaccaactaccctgggcgctttacaaacttgttggacgtggccgaggcttgcccgaccttcctctgttttgacgacgggaaaccgtacgttgtgacaaggacggacgaccaacgcctcctggccaagtttgacgtttctcttgctgcaaagcacatgtcaaacacctacctctcagggatagcacagtactacacgcagtactctggcactatcaatctgcatttcatgttcactggctctactgaatcaaaggcccggtacatggtggcgtacattccacctggcatggacaacccaccggacacacctgagaaggctgcacactgcatccacgccgagtgggacaccgggctgaactccaaatttactttttctatcccgtacgtgtctgctgcagactacgcatacactgcgtctgacgtggcagaaacaacaaacgtacaggggtgggtctgcatataccaaatcactcacgggaaggctgaacaggacactctggtcgtgtcggtcagcgccggcaaggactttgaactgcgcctcccaattgacccccgcacgcaaaccaccactgccggggagtcagcagaccctgtcaccaccaccgttgagaactacggtggtgagacacaggctcagcgacgtcagcacactgacgtcggcttcatcatggacaggtttgcgaaaatcagccccgtgagccccacgcacgtcattgacctcatgcaaacacaccaacacgcgttggtgggtgcccttttgcgtgcagccacgtactacttctccgatctggagattgtggtgcgtcatgatggcaacttgacgtgggtgcccaatggagcacctgtagaagccttggccaacacaagcaaccccaccgcctaccacaagcagccatttacgagacttgcgctcccttacaccgcgccgcaccgagtgttggcaacagtgtataacggagtaagcaagtactctacaactggtaatggcagaaggggtgacctggggcctcttgcggcgcgggtcgccgcacagctccccagctctttcaattttggtgcaattcgggccacgaccgtccacgagcttctcgtgcgcatgaaacgtgccgagctctactgtcccaggcctctgctggcagtggaagtgttgtcgcaggacagacacaagcaaaagatcattgcacctgcaaagcaactcctgaacttcgacctgctcaagttggcgggagacgttgagtccaaccctgggccc

SEQ ID NO: 108 - protein, 754 aa, Foot-and-mouth disease virus
GAGQSSPATGSQNQSGNTGSIINNYYMQQYQNSMDTQLGDNAISGGSNEGSTDTTSTHTTNTQNNDWFSKLASSAFSGLFGALLADKKTEETTLLEDRILTTRNGHTTSTTQSSVGVTYGYSTGEDHVSGPNTSGLETRVVQAERFFKKHLFDWTTDKAFGHLEKLELPTEHKGVYGHLVDSFAYMRNGWDVEVTAVGNQFNGGCLLVAMVPEWKEFTPREKYQLTLFPHQFINPRTNMTAHITVPYLGVNRYDQYKQHKPWTLVVMVVSPLTTSSIGASQIKVYANIAPTFVHVAGELPSKEGIVPVACTDGYGGLVTTDPKTADPVYGMVYNPPRTNYPGRFTNLLDVAEACPTFLCFDDGKPYVVTRTDDQRLLAKFDVSLAAKHMSNTYLSGIAQYYTQYSGTINLHFMFTGSTESKARYMVAYIPPGMDNPPDTPEKAAHCIHAEWDTGLNSKFTFSIPYVSAADYAYTASDVAETTNVQGWVCIYQITHGKAEQDTLVVSVSAGKDFELRLPIDPRTQTTTAGESADPVTTTVENYGGETQAQRRQHTDVGFIMDRFAKISPVSPTHVIDLMQTHQHALVGALLRAATYYFSDLEIVVRHDGNLTWVPNGAPVEALANTSNPTAYHKQPFTRLALPYTAPHRVLATVYNGVSKYSTTGNGRRGDLGPLAARVAAQLPSSFNFGAIRATTVHELLVRMKRAELYCPRPLLAVEVLSQDRHKQKIIAPAKQLLNFDLLKLAGDVESNPGP

SEQ ID NO: 109 - DNA, 2277 bp, Foot-and-mouth disease virus
  CDS (1)..(2277)
  misc_feature (1)..(2277): SAT2 Egypt 2010; P1; Accession: KC440884
ggggccgggcaatccagcccggctactggatcccaaaatcaatcaggcaatactggtagcattattaacaactactacatgcaacagtaccagaactcaatggacacacagcttggtgacaacgccattagcggtggttccaacgaggggtcgacggacaccacgtcgacacacacaaacaacacacagaacaatgactggttttccaaattggctcaatcagccatttcagggcttttcggagctctgcttgcagacaagaaaacagaggagaccacactgctggaggacagaatcctgaccacgcgtcacgggaccacgacctccaccacgcaaagttctgtgggagtgacatttggttatgctgatgctgattcgtttcgcccaggacccaacacctctgggcttgagacgcgcgtgcaacaggcagaacgcttcttcaaggagaagctttttgactggaccagtgacaaacctttcggtacgctgtacgtgttggagttgcccaaagaccacaagggcatctacggtaaacttaccgactcctacacgtacatgcgtaacggttgggacgttcaggtcagcgcgaccagcacacagtttaacggcggatcactgctcgtggcaatggtcccagagttgtgcagtctaaaagccagagaagaatttcaactcactctctacccacaccagttcattaacccgcgcaccaacacaaccgcacacatacaggttccttacctgggtgtaaacagacacgaccagggtaagcgccaccaggcgtggtctctggttgtgatggtgctcacgcctcttaccaccgaggcgcagatgaacagcggcaccgtcgaggtgtacgccaacatcgcaccaacaaatgtggttgtggcgggtgaactgccgggtaagcagggcatcattccggtcgctgccgctgacgggtatggtggtttccagaacaccgacccgaaaacggctgaccccatttacgggcatgtgtacaacccgtccagaaacgactgccacgggcgatactccaatcttatggatgtcgccgaggcgtgtccaacactcctcaactttgatggcaagccctacgtcgtgaccaagaacaacggtgacaaggtgatggcacgcttcgacgtcgcctttacacacaaggtgcatgggaacacgtttctggcgggcttggccgactactacacacagtattcaggcagcctaaactaccacttcatgtacactggacccacacatcacaaggcaaagttcatggtggcatacgtgccccctggtgttgcagttgaccagctgcctagcacaccggaggatgctgcgcactgctaccatgcggaatgggacaccgggttgaattcttctttctcgttcgcagtgccttacatctccgctgcggacttttcttacacacacacagacacaccggccatggccaccaccaatggctgggtggttgtactgcaggtcaccgacacgcactctgcggaagctgccgttgtagtgtcagtcagcgcgggaccagatttggaattccgattccctatcgaccctgtgcgacagactacctcggcgggagaaggcgcagatgttgtcaccacggacccatcgacacacggtgggaatgttcaagagggtcgacgcaaacacaccgacgttgcgttccttcttgatcgcagtacacacgttcacacaaataagacatcttttgttgtggacctcatggacacaagggagaaggcgctcgtaggcgcaatcctgcgagcatccacctactacttttgtgaccttgaaattgcatgtgtgggcgaccacacaagggtcttctggcagcccaacggggcaccgcggactacccagctcggcgacaaccctatggtttttgccaagggcggcgtaacccgctttgccatcccgtttacggctccacacaggctgctgtctactgtttacaacggcgagtgtgtctacaccaaggccgccgctgccattcgtggtgatcgtgcggcacttgcggcaaagtacgctgacaccaaccacactttgccgccaaccttcaacttcgggtacgtgaccgttgacaaaccagtcgacgtttactaccggatgaagagggctgagctgtactgcccacgcccactgctgccagcctacaaacacacagacagagacagattcgacgcgcccatcggcgtcgaaagacagaccctgaattttgacctgctgaaactggcaggagacgttgagtccaaccctgggccc

SEQ ID NO: 110 - protein, 759 aa, Foot-and-mouth disease virus
GAGQSSPATGSQNQSGNTGSIINNYYMQQYQNSMDTQLGDNAISGGSNEGSTDTTSTHTNNTQNNDWFSKLAQSAISGLFGALLADKKTEETTLLEDRILTTRHGTTTSTTQSSVGVTFGYADADSFRPGPNTSGLETRVQQAERFFKEKLFDWTSDKPFGTLYVLELPKDHKGIYGKLTDSYTYMRNGWDVQVSATSTQFNGGSLLVAMVPELCSLKAREEFQLTLYPHQFINPRTNTTAHIQVPYLGVNRHDQGKRHQAWSLVVMVLTPLTTEAQMNSGTVEVYANIAPTNVVVAGELPGKQGIIPVAAADGYGGFQNTDPKTADPIYGHVYNPSRNDCHGRYSNLMDVAEACPTLLNFDGKPYVVTKNNGDKVMARFDVAFTHKVHGNTFLAGLADYYTQYSGSLNYHFMYTGPTHHKAKFMVAYVPPGVAVDQLPSTPEDAAHCYHAEWDTGLNSSFSFAVPYISAADFSYTHTDTPAMATTNGWVVVLQVTDTHSAEAAVVVSVSAGPDLEFRFPIDPVRQTTSAGEGADVVTTDPSTHGGNVQEGRRKHTDVAFLLDRSTHVHTNKTSFVVDLMDTREKALVGAILRASTYYFCDLEIACVGDHTRVFWQPNGAPRTTQLGDNPMVFAKGGVTRFAIPFTAPHRLLSTVYNGECVYTKAAAAIRGDRAALAAKYADTNHTLPPTFNFGYVTVDKPVDVYYRMKRAELYCPRPLLPAYKHTDRDRFDAPIGVERQTLNFDLLKLAGDVESNPGP

SEQ ID NO: 111 - DNA, 2247 bp, Foot-and-mouth disease virus
  CDS (1)..(2247)
  misc_feature (1)..(2247): C3 indaial;  P1; Accession: AY593806
ggagccggacaatccagcccggcgactggctcgcagaaccaatctggcaacactggtagcataatcaacaactactacatgcaacagtaccaaaattccatggacacacagctgggtgacaatgctattagtggtggctccaacgagggctccacagatacaacttccacccacacaaccaacactcaaaacaacgactggttttccaaactcgccagttctgcctttagcggtcttttcggtgctcttcttgccgacaagaagaccgaggaaaccacactacttgaagaccgcatcctcaccacccgcaacggccacacgacgtcgacaactcagtcgagcgttggggtcacatacgggtacgcaacaactgaggatagcacgtcagggcccaacacatccggccttgagacacgtgttcaccaggcagaacggtttttcaagatgacactctttgaatgggttccctcccagagttttggacacatgcacaaggtcgttctgccctcagaaccgaaaggtgtctatgggggtctcgtcaagtcatacgcgtacatgcgcaatggctgggacgttgaggtgactgctgttggaaaccagttcaacggcggttgtctcctggtggcgctcgttcctgaaatgggtgacatcagtgacagagagaagtaccaactgactctctacccccaccaattcatcaacccacgcactaacatgacggcacacatcaccgtgccttacgtgggtgtcaacagatacgaccaatacaaccaacacaagccctggactcttgtcgtcatggtcgttgctccacttactgtgaacacatcaggtgcccagcagatcaaggtgtatgccaacatagccccaaccaacgttcacgttgctggtgaacttccctccaaggaggggatcttccccgttgcgtgtgccgacggctatggcaacatggtgacaactgacccgaagacagctgaccctgcctacgggaaagtctacaatccacccaggaccgccctgccgggccggttcacaaactacctggatgttgctgaggcttgccccactctcctgacgttcgagaacgtgccttacgtttcaacacggactgatggacaaaggctgttggccaagttcgacgtgtcattggcagcgaaacacatgtcaaacacttacttggctggcttggcccagtactacacacagtacgctgggacaatcaacctgcacttcatgttcactgggccaaccgacgcgaaagctcggtacatggtggcatacgtgccccctggcatggaagcaccagacaacccagaggaggctgcccactgcatacacgcagagtgggacactggtttgaactctaagttcacattttcaatcccgtacatctcggccgctgactacgcatacaccgcgtccagcgaggctgaaacaacaagcgtacagggatgggtttgtgtgtaccagatcactcacggcaaggcagacgctgacgcgctcgtcgtctccgcttcggcggggaaagactttgagctccggctacctgtggacgctagacagcaaactacgaccactggcgaatctgccgaccccgtcaccactaccgttgagaactacggaggagaaacacaaactcaacgtcgccaccacactgacgttgccttcgttcttgaccggtttgtgaaggtccaggtgtcgggcaaccaacacacactggacgttatgcaggtacacaaggacagtattgtgggtgcactcctacgcgcagccacatactacttctctgacttggaaatagcagtgactcacactgggaagctcacatgggtgcccaacggcgccccagtttctgcacttgacaacacaaccaaccccactgcctaccacaaggggccgctgactcggctggctctcccatacaccgcaccacaccgcgtgctggccacggcgtacaccggtacaacggcctacactaccggtgtacgcaggggagacctagcccacttggcggcggcgcacgctcggcacctgccgacgtcgttcaactttggtgcagttaaagcagagacaatcacagagctgcttgtgcgcatgaagcgtgctgaactctactgccccagaccggtccttccggtccaaccagcgggcgataggcacaaacaaccgctcattgcgccagcgaaacagctgctgaacttcgaccttctcaagttggcgggagacgtcgagtccaaccctgggccc

SEQ ID NO: 112 - protein, 749 aa, Foot-and-mouth disease virus
GAGQSSPATGSQNQSGNTGSIINNYYMQQYQNSMDTQLGDNAISGGSNEGSTDTTSTHTTNTQNNDWFSKLASSAFSGLFGALLADKKTEETTLLEDRILTTRNGHTTSTTQSSVGVTYGYATTEDSTSGPNTSGLETRVHQAERFFKMTLFEWVPSQSFGHMHKVVLPSEPKGVYGGLVKSYAYMRNGWDVEVTAVGNQFNGGCLLVALVPEMGDISDREKYQLTLYPHQFINPRTNMTAHITVPYVGVNRYDQYNQHKPWTLVVMVVAPLTVNTSGAQQIKVYANIAPTNVHVAGELPSKEGIFPVACADGYGNMVTTDPKTADPAYGKVYNPPRTALPGRFTNYLDVAEACPTLLTFENVPYVSTRTDGQRLLAKFDVSLAAKHMSNTYLAGLAQYYTQYAGTINLHFMFTGPTDAKARYMVAYVPPGMEAPDNPEEAAHCIHAEWDTGLNSKFTFSIPYISAADYAYTASSEAETTSVQGWVCVYQITHGKADADALVVSASAGKDFELRLPVDARQQTTTTGESADPVTTTVENYGGETQTQRRHHTDVAFVLDRFVKVQVSGNQHTLDVMQVHKDSIVGALLRAATYYFSDLEIAVTHTGKLTWVPNGAPVSALDNTTNPTAYHKGPLTRLALPYTAPHRVLATAYTGTTAYTTGVRRGDLAHLAAAHARHLPTSFNFGAVKAETITELLVRMKRAELYCPRPVLPVQPAGDRHKQPLIAPAKQLLNFDLLKLAGDVESNPGP

SEQ ID NO: 113 - DNA, 2277 bp, Foot-and-mouth disease virus
  CDS (1)..(2277)
  misc_feature (1)..(2277): SAT3 ZIM/6/91; P1; Accession: DQ009740
ggagcgggccagtcttcccctgccacagggtcgcagaaccaatctggcaacactggcagcatcataaacaactactacatgcagcagtaccagaattcaatggacacccagcttggcgacaacgccatctcgggtggttcaaatgaaggcagcacggacaccacgtccacacacaccaacaacacccaaaacaatgattggttttcaaaattggcccaatccgccatttcaggactcttcggggctctgttggcggacaaaaagaccgaggaaacaaccttgctcgaggaccgaatcctcacaacacgccacaatactaccacatccaccacgcagagttcggtgggagtgacgtacggttacgcgtccgctgaccggtttctcccaggaccgaacacaagtgggctggaaacgcgagtggaacaggccgagagattcttcaaggagagactcttcacttggaccgcttcgcagcagtacgcccacgttcacctgcttgaacttcccaccgaccacaagggcatctacggtgccatggtggacaaccacgcgtacatacgcaacggatgggacgtgcaggtctccgcgaccagcacgcagttcaatggtggtacattgctcgtggcaatggtcccagagttacacgcgctcgacacgcgtagtgtttcacagctcacgctgtttccacaccaattcatcaacccacgcacaaacaccactgcccacattgtggttccctacattggggtaaacaggcatgaccaggtaaaaatgcacaaggcctggacattggtggtcgcggttctcgcaccgctcaccacatcaaacatgggacaggacaacgttgaggtgtacgccaacatcgcaccaaccaacgtttttgtggctggcgagaagcctaccaaacaaggcatcttccccgtggcctgcaacgacggctacggtggctttcagaacactgatcccaagacctctgaccccatatacgggctggtggcaaacccacctcgcaccgcttttcccgggaggttcaccaacttcctggacgtggcggaggcatgcccgacctttctggacttcaacggaacaccttacgtcaagaccagacacaacagtgggagcaagatactcacccacatagatttggcttttgggcacaagagtttcaagaacacttatcttgctggtctcgcccagtattacgcccaatacagtggatctctcaacctgcacttcatgtacacgggtcccacgcaatcaaaggcacgctttatggttgcatacgtaccacccgggacggagcccgtaccatcaacacccgaggaagcggcgcactgctaccactcggaatgggacactggactgaactccaagttcacgttcacagtgccgtacatgtctgcagctgactatgcctacacctactgcgacgagcctgaacaggcctccgcacaagggtgggtaacactgtaccaaattactgacacacatgaccctgattcggctgtcctcatctcagttagcgcaggcgctgactttgagctcaggctgcccatcaaccccgttactcagacaacgagcgcgggggaaggcgcagacgtggtgaccacggacgttaccacccatggaggaacagttgacacaccaagaaggcagcacaccaacgtggagtttctgctggacagattcacacacattgggtcgatcaccgcctcaaagaccattgacctcctcgagacaaaagaacacacgctggtgggcgcactcctgcgttcagctacgtactacttttgtgacctcgaggtcgcggtgcttggcaacgcgaagtgggttggatgggtgccgaatggctgcccacacaccgaccgcgtggaagacaacccagtcgttcacgccaaggggaatgttacccgctttgcactgccctacacagccccgcacggagtgcttgccacgacctacaacgggacttgcaagtattccaagacgcaaagtgttaaaccacgccgtggcgacatggctgtgctggcacaacgcgttgaaggtgaacaacaaagatgcaaacccacgacattcaacttcggtcgattgttgtgtgattcgggtgacgtgtactaccgaatgaagcgggccgagctttactgcccacgtccgctgatggtcaggtacactcacaccacagacagatacaaagttgcgcttgtgtcaccagctaagcaactgtgcaacttcgacctgttaaagttggctggagatgttgagtccaaccctgggccc

SEQ ID NO: 114 - protein, 759 aa, Foot-and-mouth disease virus
GAGQSSPATGSQNQSGNTGSIINNYYMQQYQNSMDTQLGDNAISGGSNEGSTDTTSTHTNNTQNNDWFSKLAQSAISGLFGALLADKKTEETTLLEDRILTTRHNTTTSTTQSSVGVTYGYASADRFLPGPNTSGLETRVEQAERFFKERLFTWTASQQYAHVHLLELPTDHKGIYGAMVDNHAYIRNGWDVQVSATSTQFNGGTLLVAMVPELHALDTRSVSQLTLFPHQFINPRTNTTAHIVVPYIGVNRHDQVKMHKAWTLVVAVLAPLTTSNMGQDNVEVYANIAPTNVFVAGEKPTKQGIFPVACNDGYGGFQNTDPKTSDPIYGLVANPPRTAFPGRFTNFLDVAEACPTFLDFNGTPYVKTRHNSGSKILTHIDLAFGHKSFKNTYLAGLAQYYAQYSGSLNLHFMYTGPTQSKARFMVAYVPPGTEPVPSTPEEAAHCYHSEWDTGLNSKFTFTVPYMSAADYAYTYCDEPEQASAQGWVTLYQITDTHDPDSAVLISVSAGADFELRLPINPVTQTTSAGEGADVVTTDVTTHGGTVDTPRRQHTNVEFLLDRFTHIGSITASKTIDLLETKEHTLVGALLRSATYYFCDLEVAVLGNAKWVGWVPNGCPHTDRVEDNPVVHAKGNVTRFALPYTAPHGVLATTYNGTCKYSKTQSVKPRRGDMAVLAQRVEGEQQRCKPTTFNFGRLLCDSGDVYYRMKRAELYCPRPLMVRYTHTTDRYKVALVSPAKQLCNFDLLKLAGDVESNPGP

SEQ ID NO: 115 - DNA, 2289 bp, Foot-and-mouth disease virus
  CDS (1)..(2289)
  misc_feature (1)..(2289): SAT1 KNP/196/91;P1; Accession: KR108948
ggagcgggccagtcgtcccccgccactgggtcccagaaccagtctggcaacactggcagcatcatcaacaactactacatgcaacagtaccaaaattccatggacacccaactcggagacaacgccatctccggtgggtcaaatgagggttcgaccgacacaacgtcgacccacaccagcaacacccaaaacaacgattggttttcaaaattggctcaatcggccttctctggattggttggtgcgttgcttgccgacaagaagactgaggaaaccacactcctcgaggatcgcatcctcacgaccagtcacggcacaaccacctcgaccacacaaagttcagtgggcataacctacggttacgccgactcggaccgtttcctccccggcccaaacaccaacgggctggagacacgtgtggaacaagcagagaggtttttcaaacacaaattatttgattggacacttgaacaacgatttggaacaacacacgttttggaactgcccacagaccacaaaggcatctatggacaacttgttgactcccactcatacattcgcaatgggtgggacgttgaggtctccgcgaccgcaacgcagttcaacgggggctgcctcctggtagcgatggtgcccgaattgtgcaaactgtcggaaagagagaaataccaactcactctcttccctcatcaatttctcgacccaaggaccaacaccacggcacacatccaggtaccctacctgggcgtggatcgccacgaccaaggaacacgccacaaagcgtggaccctggttgtcatggtggtggcaccctacacaaacgatcagacgattggctcgaacaaagccgaggtgtacgtgaacattgctcccacaaacgtttacgtcgccggtgagaagcccgcaaaacagggcattctccccgtggccgtctccgttggctatggtggcttccaaaatacagatcccaaaacatcggaccccgtatacgggcacgtgtacaacccggctcgcaccggcctacctgggaggttcacaaacctcttggatgtggctgaagcgtgccctacactgcttgacttcaacggagttccgtacgtgaccacccaggcaaactctggatctaaagtgttaacttgttttgatttggcttttggtcacaaaaatttgaaaaatacatttatgtctggtcttgcccagtactacacccagtacagtggcacactcaacctgcacttcatgtacacaggcccaaccaacaacaaggctaagtacatggtggcctacatcccacctgggacacaccctctcccggaaacaccggagatggagtcccactgtcaccacgccgagtgggacacaggcctgaactcaaccttcacattcaccgtgccgtacgtgtcggctgccgacttcgcgtacacctactctgacgagcctgaacaggcttcggttcagggttgggtgggcgtataccaggtgactgacacacacgagaaggacggtgcagttgttgtgtccgtcagtgctggacccgacttcgagttcaggatgcccatcagcccctcgcgccagaccacatccgctggcgaaggagcggagcctgtcacgactgatgcttcccaacacggaggcgacagacggacaactcgtaggcatcacactgatgtgagcttcttgctcgaccggttcacactggttggtaaaacacaggacaacaaactgacactagacctgctccaaaccaaggaaaaagcactggttggcgcaatcctgcgcgcagccacgtactacttctctgacttggaggttgcgtgtgtgggtgacaacaaatgggtcggctggactcccaacggagctccagaacttgcggaagtgggcgacaacccagtcgtcttttccaaaggtagaaccacccgttttgcactgccctacaccgctccacacaggtgcttggcgacagcctacaacggtgactgcaagtacaaacccactggcacagctccacgcgaaaacattcgtggagacctcgcaactctcgcggcgaggattgcaagtgagacacacattccaaccaccttcaactatggcaggatttacacagacactgaggtcgacgtgtacgtcaggatgaagcgcgcggagctctactgcccgcgacccgttctcacgcactacgaccacggtggcagggatcgctacagaactgcgatcaccaaacctgtcaaacagatgtgcagtttcgacctgttaaagctggctggagacgttgagtccaaccctgggccc

SEQ ID NO: 116 - protein, 763 aa, Foot-and-mouth disease virus
GAGQSSPATGSQNQSGNTGSIINNYYMQQYQNSMDTQLGDNAISGGSNEGSTDTTSTHTSNTQNNDWFSKLAQSAFSGLVGALLADKKTEETTLLEDRILTTSHGTTTSTTQSSVGITYGYADSDRFLPGPNTNGLETRVEQAERFFKHKLFDWTLEQRFGTTHVLELPTDHKGIYGQLVDSHSYIRNGWDVEVSATATQFNGGCLLVAMVPELCKLSEREKYQLTLFPHQFLDPRTNTTAHIQVPYLGVDRHDQGTRHKAWTLVVMVVAPYTNDQTIGSNKAEVYVNIAPTNVYVAGEKPAKQGILPVAVSVGYGGFQNTDPKTSDPVYGHVYNPARTGLPGRFTNLLDVAEACPTLLDFNGVPYVTTQANSGSKVLTCFDLAFGHKNLKNTFMSGLAQYYTQYSGTLNLHFMYTGPTNNKAKYMVAYIPPGTHPLPETPEMESHCHHAEWDTGLNSTFTFTVPYVSAADFAYTYSDEPEQASVQGWVGVYQVTDTHEKDGAVVVSVSAGPDFEFRMPISPSRQTTSAGEGAEPVTTDASQHGGDRRTTRRHHTDVSFLLDRFTLVGKTQDNKLTLDLLQTKEKALVGAILRAATYYFSDLEVACVGDNKWVGWTPNGAPELAEVGDNPVVFSKGRTTRFALPYTAPHRCLATAYNGDCKYKPTGTAPRENIRGDLATLAARIASETHIPTTFNYGRIYTDTEVDVYVRMKRAELYCPRPVLTHYDHGGRDRYRTAITKPVKQMCSFDLLKLAGDVESNPGP

SEQ ID NO: 117 - DNA, 2250 bp, Foot-and-mouth disease virus
  CDS (1)..(2250)
  misc_feature (1)..(2250): Asia1 Shamir; P1
ggagccggtcaatccagtccggcaaccgggtcacagaaccaatctggcaacactggaagcatcattaacaactactacatgcaacagtaccagaattccatggacacacagcttggtgacaacgctattagcggaggttccaacgaaggttccacggataccacttccacacacacaaacaacacccaaaacaacgactggttctcgcgcctggctagctctgcattcagtggtctctttggtgcacttttggctgacaagaagacagaagagacaactctgcttgaagaccgcattctcaccaccaggaacggccacacaacatcgacgacacagtcgagcgttggcgtaacatacggttacgctgtggccgaggacgcggtgtctggacccaatacctcgggtctagagactcgtgttcaacaggcagaacggtttttcaagaaacacctgtttgactggacaccgaacttggcatttggacactgttactacctggaacttcccactgaacacaaaggcgtgtacggcagtctcatgggctcgtacgcctacatgagaaatggatgggacatagaggtgactgctgttggaaaccaattcaacggtggttgtctccttgtcgcgctcgtgccagagctgaaggaactcgacacgcgacagaagtaccagctgaccctctttccccaccagttcatcaacccacgcaccaacatgacggcccacatcaacgtgccgtacgtgggtatcaacaggtacgaccagtacgccctccacaagccgtggacgcttgttgtgatggtggtagccccactcaccgtcaaaactggtggttctgaacagatcaaggtttacatgaatgcagcgccaacctacgtgcatgtggcgggagagctgccctcgaaagagggaatagttcccgtcgcgtgtgcggacggttacggcaacatggtgaccacggacccgaagacggccgatccagtttacgggaaagtgttcaacccccccaggacaaacctccctgggcgcttcacgaacttccttgatgttgcggaggcatgtccaactttcctccgctttggagaagtaccatttgtgaagacggtgaactctggtgaccgcttgctggccaagttcgacgtgtccctcgctgcagggcacatgtccaacacctacttggctggcctggcgcagtactacacacagtacagcggcaccatgaacgtccacttcatgttcaccgggcccacggatgctaaagcccgatacatggtggcttatgtcccccctggcatgacaccgcccacggaccctgagcacgccgcacactgcattcactctgagtgggatactggtcttaactctaagtttaccttttccataccttacctctctgctgctgactatgcctacactgcttctgacgtggcggagaccacgagtgtgcagggatgggtgtgtatctatcagatcacccacggcaaggctgagggagacgcactggtcgtttctgtcagcgccggcaaagactttgagtttcgcttgcctgttgacgcacgccagcaaaccaccaccactggcgaatcagcagatccagtcacaaccacggttgagaactatggaggagagactcagacagccagacggcttcacactgacgtcgccttcattcttgacaggtttgtgaaactcactgctcccaagaacatccaaaccctcgatctcatgcagatcccctcacacacgctggttggagcactacttcgttctgcgacgtactacttctcagacctggaggtcgcgcttgtccacacaggcccggtcacctgggtgcccaacggcgcgcccaaggatgctctaaacaaccagaccaacccaactgcctatcagaagcaacccatcacccgcctggcactcccctacaccgccccccatcgtgtgctggcaacagtgtacaacgggaagacggcgtacggggaaacgacctcaaggcgcggcgacatggcggccctcgcacaaaggttgagcgctcggctgcccacctccttcaactacggcgccgtgaaggccgacaccatcactgagcttttgatccgcatgaagcgcgcggagacatattgccctaggcctttactagcccttgacaccactcaggaccgccgcaaacaggagatcattgcacctgagaagcaggttttgaactttgacctactcaagttggcaggagacgttgagtccaaccctgggccc

SEQ ID NO: 118 - protein, 750 aa, Foot-and-mouth disease virus
GAGQSSPATGSQNQSGNTGSIINNYYMQQYQNSMDTQLGDNAISGGSNEGSTDTTSTHTNNTQNNDWFSRLASSAFSGLFGALLADKKTEETTLLEDRILTTRNGHTTSTTQSSVGVTYGYAVAEDAVSGPNTSGLETRVQQAERFFKKHLFDWTPNLAFGHCYYLELPTEHKGVYGSLMGSYAYMRNGWDIEVTAVGNQFNGGCLLVALVPELKELDTRQKYQLTLFPHQFINPRTNMTAHINVPYVGINRYDQYALHKPWTLVVMVVAPLTVKTGGSEQIKVYMNAAPTYVHVAGELPSKEGIVPVACADGYGNMVTTDPKTADPVYGKVFNPPRTNLPGRFTNFLDVAEACPTFLRFGEVPFVKTVNSGDRLLAKFDVSLAAGHMSNTYLAGLAQYYTQYSGTMNVHFMFTGPTDAKARYMVAYVPPGMTPPTDPEHAAHCIHSEWDTGLNSKFTFSIPYLSAADYAYTASDVAETTSVQGWVCIYQITHGKAEGDALVVSVSAGKDFEFRLPVDARQQTTTTGESADPVTTTVENYGGETQTARRLHTDVAFILDRFVKLTAPKNIQTLDLMQIPSHTLVGALLRSATYYFSDLEVALVHTGPVTWVPNGAPKDALNNQTNPTAYQKQPITRLALPYTAPHRVLATVYNGKTAYGETTSRRGDMAALAQRLSARLPTSFNYGAVKADTITELLIRMKRAETYCPRPLLALDTTQDRRKQEIIAPEKQVLNFDLLKLAGDVESNPGP

SEQ ID NO: 119 - DNA, 90 bp, Artificial Sequence
  Delta 1D2A interrupter sequence
  CDS (1)..(90)
  misc_feature (34)..(87): Nucleotides 34-87 code for the 2A sequence.
cayaagcaaaagatcattgcaccagcaaagcagcttctgaattttgacctgctcaagttggccggagacgttgagtccaaccctggaccc

SEQ ID NO: 120 - protein, 30 aa, Artificial Sequence
  Synthetic Construct
HKQKIIAPAKQLLNFDLLKLAGDVESNPGP

SEQ ID NO: 121 - DNA, 2916 bp, Artificial Sequence
  mpTarget O1P1-3C(L127P) transgene
atgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtaa

SEQ ID NO: 122 - DNA, 2916 bp, Foot-and-mouth disease virus
  misc_feature (1)..(2916): L127P/C142T transgene; mpTarget O1P1-3CDNA
atgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgaccatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtaa

SEQ ID NO: 123 - DNA, 3113 bp, Artificial Sequence
  mpTarget Empty
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagcttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagggatcccccgggttaatgcttcgagaagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgactcgagtggcacttttcggggaaatgtgcgcggaacccctatttgtttatttttctaaatacattcaaatatgtatccgctctcgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgtcagaccaagtttactcatatatactttagattgatttaaaacttcatttttaatttaaaaggatctaggtgaagatcctttttgataatctcatgaccaaaatcccttaacgtgagttttcgttccactgagcgggtaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 124 - DNA, 6038 bp, Artificial Sequence
  L127P Vector and Transgene;  mpTarget O1P1-3CDNA
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagcttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagggatccgccgccgccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtaacccgggttaatgcttcgagaagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgactcgagtggcacttttcggggaaatgtgcgcggaacccctatttgtttatttttctaaatacattcaaatatgtatccgctctcgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgtcagaccaagtttactcatatatactttagattgatttaaaacttcatttttaatttaaaaggatctaggtgaagatcctttttgataatctcatgaccaaaatcccttaacgtgagttttcgttccactgagcgggtaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 125 - DNA, 6038 bp, Artificial Sequence
  L127P/C142T; Vector and Transgene; mpTarget O1P1-3CDNA
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagcttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagggatccgccgccgccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgaccatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtaacccgggttaatgcttcgagaagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgactcgagtggcacttttcggggaaatgtgcgcggaacccctatttgtttatttttctaaatacattcaaatatgtatccgctctcgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgtcagaccaagtttactcatatatactttagattgatttaaaacttcatttttaatttaaaaggatctaggtgaagatcctttttgataatctcatgaccaaaatcccttaacgtgagttttcgttccactgagcgggtaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 126 - DNA, 1743 bp, Artificial Sequence
  Minicircle Empty
cccttgggctccccgggcgcgactagtgaattgatactagtattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtttatataagcagagctcgtttagtgaaccgtcagatcgcctggagacgccatccacgctgttttgacctccatagaagattctagagtcgacgcggccgcggatccgaattcgctagctcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggtacctttaagaccaatgacttacaaggcagctgtagatcttagccactttttaaaagaaaaggggggactggaagggctaattcactcccaacgaagataagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagacttttgcagatcgacccatgggggcccgccccaactggggtaacct

SEQ ID NO: 127 - DNA, 4668 bp, Artificial Sequence
  L127P Vector and transgene;  Minicircle O1P1-3CDNA
cccttgggctccccgggcgcgactagtgaattgatactagtattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtttatataagcagagctcgtttagtgaaccgtcagatcgcctggagacgccatccacgctgttttgacctccatagaagattctagagtcgacgcggccgcggatccgccgccgccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtaggaattcgctagctcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggtacctttaagaccaatgacttacaaggcagctgtagatcttagccactttttaaaagaaaaggggggactggaagggctaattcactcccaacgaagataagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagacttttgcagatcgacccatgggggcccgccccaactggggtaacct

SEQ ID NO: 128 - DNA, 4668 bp, Artificial Sequence
  L127P/C142T Vector and transgene; Minicircle O1P1-3CDNA
cccttgggctccccgggcgcgactagtgaattgatactagtattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtttatataagcagagctcgtttagtgaaccgtcagatcgcctggagacgccatccacgctgttttgacctccatagaagattctagagtcgacgcggccgcggatccgccgccgccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgaccatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtaggaattcgctagctcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggtacctttaagaccaatgacttacaaggcagctgtagatcttagccactttttaaaagaaaaggggggactggaagggctaattcactcccaacgaagataagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagacttttgcagatcgacccatgggggcccgccccaactggggtaacct

SEQ ID NO: 129 - DNA, 3576 bp, Artificial Sequence
  O1P1-3C(wt)-SGLuc
atgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagaaggcagaattcagccacaagcaaaagatcattgcaccagcaaagcagcttctgaattttgacctgctcaagttggccggagacgttgagtccaaccctggaccaatgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 130 - DNA, 3576 bp, Artificial Sequence
  O1P1-3C(V28K)-SGLuc
atgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacgaaggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagaaggcagaattcagccacaagcaaaagatcattgcaccagcaaagcagcttctgaattttgacctgctcaagttggccggagacgttgagtccaaccctggaccaatgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 131 - DNA, 3576 bp, Artificial Sequence
  O1P1-3C(L127P)-SGLuc
atgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagaaggcagaattcagccacaagcaaaagatcattgcaccagcaaagcagcttctgaattttgacctgctcaagttggccggagacgttgagtccaaccctggaccaatgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 132 - DNA, 3576 bp, Artificial Sequence
  O1P1-3C(V141T)-SGLuc
atgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtaacgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagaaggcagaattcagccacaagcaaaagatcattgcaccagcaaagcagcttctgaattttgacctgctcaagttggccggagacgttgagtccaaccctggaccaatgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 133 - DNA, 3576 bp, Artificial Sequence
  O1P1-3C(C142T)-SGLus
atgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgaccatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagaaggcagaattcagccacaagcaaaagatcattgcaccagcaaagcagcttctgaattttgacctgctcaagttggccggagacgttgagtccaaccctggaccaatgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 134 - DNA, 3576 bp, Artificial Sequence
  O1P1-3C(C163A)-SGLuc
atgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctacgctggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagaaggcagaattcagccacaagcaaaagatcattgcaccagcaaagcagcttctgaattttgacctgctcaagttggccggagacgttgagtccaaccctggaccaatgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 135 - DNA, 3576 bp, Artificial Sequence
  L127P/C142T-SGLuc; O1P1-3C DNA
atgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgaccatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagaaggcagaattcagccacaagcaaaagatcattgcaccagcaaagcagcttctgaattttgacctgctcaagttggccggagacgttgagtccaaccctggaccaatgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 136 - DNA, 2259 bp, Artificial Sequence
  O1 Manisa Iso87 restriction sites removed
ggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggccc

SEQ ID NO: 137 - DNA, 2259 bp, Artificial Sequence
  O1 pan Asia restriction sites removed
ggtgctgggcaatccagcccggcgactgggtcacagaaccagtcaggcaacactggaagcatcatcaacaactactacatgcagcagtaccagaactccatggacacacaacttggtgacaacgctatcagcggaggctctaacgaaggttctacagacaccacctccacccacacaaccaacactcagaacaacgactggttttcaaaactagccagttccgctttcagcggtcttttcggcgctcttctcgccgacaagaaaaccgaggagactactcttcttgaggaccgcatcctcactacccgtaacggacacacaacctcgacaacccagtcgagcgttggagtcacttacgggtacgcaacagccgaggattttgtgagcgggccaaacacatctggccttgagaccagggttgtgcaagcagagcggttcttcaaaacccacttgttcgattgggtcactagtgactcgttcggacgatgccacctgctggaacttccaactgaccacaaaggtgtctatggcagcctgactgattcttatgcgtacatgagaaacggttgggatgtcgaggtcactgcggtgggaaaccagttcaacggaggatgcctgttggtggccatggtgccagaactctgctctatcagcaaaagagagctgtaccagctcacgctctttccccaccagttcatcaacccccggacgaacatgacggcacacatcaccgtgccctttgtcggcgtcaaccgctacgaccagtacaaggtacacaaaccttggaccctcgtggtcatggtcgtggccccgctgactgtcaacactgaaggtgctccacagatcaaggtttatgccaacatcgcccctaccaacgtgcacgtcgcgggtgagttcccctccaaggaagggatcttccccgtggcctgcagtgacggttacggcggtcttgtgaccactgacccaaagacggctgaccccgtttacgggaaagttttcaatccccctcgcagcatgttgccagggcgattcaccaacttccttgatgtggctgaggcgtgccctacgtttctgcattttgagggtgacgtaccatacgtgaccacaaagacggattcggacagggttctcgctcagtttgacttgtctttggcagcgaagcacatgtcaaacacctttcttgcaggtctcgcccagtactacgcacagtacagtggcactattaacctgcacttcatgttcacagggccaactgacgcgaaagcgcgttacatgattgcctatgccccccccggcatggagccgcctaaaacacctgaggcagccgctcactgcattcacgcggagtgggatactggattgaactcaaaattcacattctcaatcccttacctctcggcggctgactatgcgtacaccgcgtctgacaccgccgagaccacaaatgtacagggatgggtttgcctgtttcaaatcacgcacgggaaggccgatggtgacgcacttgttgtcctggccagcgccggtaaggacttcgagctgcggttgccagttgatgcccgcacgcagaccacctccacaggtgagtcagctgaccccgtgactgccactgttgagaactacggtggcgaaacacaggtccagagacgccagcacacggacgtctcgtttatattggacagatttgtgaaagtgacaccaaaagaccaaatcaatgtgttggacctgatgcaaacccccgcccacactttggtaggtgcactcctccgcaccgccacctactacttcgcagatttagaggtggcagtaaaacacgaggggaaccttacctgggtcccgaatggggcgcccgagacagcgttggataacaccactaatccaacggcttaccacaaggcaccgctcactcgtcttgcactgccttacacggcaccgcaccgtgtcttggctaccgtttacaacgggaactgcaagtacgacgagagcagcacaaccaacgtgagaggagacctgcaagtgttggcccaaaaggcggcgaggacgctgcccacctccttcaactacggtgccatcaaagctacacgggtgaacgagttgctttaccgcatgaagagggctgaaacatactgcccccggcctcttttggccattcatccgaatgaagcaagacacaagcaaaagatagtggcacctgcgaagcaactcctgaacttcgacctgctcaagttggcgggagacgttgagtccaaccccgggccc

SEQ ID NO: 138 - DNA, 2262 bp, Artificial Sequence
  A24 Cruzeiro iso71 restriction sites removed
ggggccgggcaatccagtccggcgaccggctcgcagaaccaatctggcaacactggcagcataattaacaactactacatgcagcaataccagaactccatggacacacagttgggagacaatgccatcagtggaggctccaacgagggctccacggacacaacttcaacacacacaaccaacactcaaaacaatgactggttctcgaagctcgccagttcagcttttacaggtctgttcggtgcactgctcgccgacaagaagacagaggaaacgacacttcttgaggaccgcatcctcaccacccgcaacgggcacaccacctcgacgacccaatcgagtgtgggtgtcacacacgggtactccacagaggaggaccacgttgctgggccaaacacatcgggcctggagacgcgagtggtgcaggcagagagattctacaaaaagtacttgtttgactggacaacggacaaggcatttggacacctggaaaagctggagctcccgtccgaccaccacggtgtctttggacacttggtggactcgtacgcctatatgagaaatggctgggatgttgaggtgtccgctgttggcaaccagttcaacggcgggtgcctcctggtggccatggttcctgaatggaaggaatttgacacacgggagaaataccaactcacccttttcccgcaccagtttattagccccagaactaacatgactgcccacatcacggtcccctaccttggtgtgaacaggtatgatcagtacaagaagcataagccctggacattggttgtcatggtcgtgtcgccacttacggtcaacaacaccagtgcggcacaaatcaaggtctatgccaacatagctccgacctatgttcacgtggccggtgaactcccctcgaaagaggggattttcccggttgcatgtgcggacggttacggaggattggtgacgacagacccgaagacagctgaccctgcttatggcaaggtgtacaacccgcctaggactaactaccctgggcgcttcaccaacctgttggacgtggccgaagcgtgtcccactttcctctgctttgacgacgggaaaccgtacgtcaccacgcggacggatgacacccgacttttggccaagtttgacctttcccttgccgcaaaacacatgtccaacacatacctgtcagggattgctcagtactacacacagtactctggcaccatcaatttgcatttcatgttcacaggttccactgattcaaaggcccgatacatggtggcctacatcccacctggggtggagacaccaccggacacacctgaaagggctgcccactgcattcacgctgaatgggacactggactaaactccaaattcactttctcaatcccgtacgtatccgccgccgattatgcgtacacagcgtctgacacggcagaaacaatcaacgtacagggatgggtctgcatctaccaaattacacacgggaaggctgaaaatgacaccttggtcgtgtcggttagcgccggcaaagactttgagttgcgcctcccgattgacccccgccagcagaccaccgctaccggggaatcagcagacccggtcacaaccaccgtggagaactacggcggtgagacacaaatccagagacgtcaccacacggacattggtttcatcatggacagatttgtgaagatccagagcttgagcccaacacatgtcattgacctcatgcagactcaccaacacggtctggtgggtgccttgctgcgtgcagccacgtactacttttctgacctggaaattgttgtacggcacgaaggcaatctgacctgggtgcccaacggcgcccctgaatcagccctgttgaacaccagcaaccccactgcctacaacaaggcaccattcacgagactcgctctcccctacactgcgccgcaccgtgtgctggcaacagtgtacaacgggacgagtaagtatgctgtgggtggttcaggcagaagaggcgacatggggtctctcgcggcgcgagtcgtgaaacagcttcctgcttcatttaactacggtgcaatcaaggccgacgccatccacgaacttctcgtgcgcatgaaacgggccgagctctactgccccagaccgctgttggcaatagaggtgtcttcgcaagacaggcacaagcaaaagatcattgcaccagcaaagcagcttctgaattttgacctgctcaagttggccggagacgttgagtccaaccctgggccc

SEQ ID NO: 139 - DNA, 2262 bp, Artificial Sequence
  A Turkey/2006 restriction sites removed
ggagccgggcaatccagtccggcaaccgggtcacaaaaccaatcaggcaacactggtagtatcatcaacaactactacatgcagcagtaccagaactccatggatacacaacttggcgacaacgccattagcggtggttccaacgagggctccactgacactacctccacacacacaaccaacacacagaacaatgactggttttcaaagctggccagttctgccttcagcggtctcttcggcgctcttctcgctgacaaaaagacagaggagactaccctcctggaagaccgcatccttaccacccgcaacggacacaccacctcgacaacccagtcgagtgtgggtgtcacctacgggtactccactggtgaagaccacgtctctggacctaacacatctggcctggagacgcgagtggtacaggcagagagattcttcaagaaacacttgtttgattggacaactgataaggcttttggacacctggaaaaactggaactccccaccgaacacaagggtgtctatgggcacttggtggactctttcgcatacatgagaaatggctgggacgtggaggtgacagccgttggcaatcagttcaacggtgggtgtctcctggtggccatggttcctgagtggaaagagtttacccctcgtgagaaataccagctcaccctgtttccacaccaatttatcaaccccagaaccaacatgacagcccacatcacggtcccgtaccttggtgtcaataggtatgaccagtacaaacagcacaaaccctggacactggtcgtgatggtggtttcgccactgaccaccagcagcattggggcctcacagattaaggtctatgccaacattgccccaaccttcgttcacgtggccggcgagctcccatcgaaagaagggatcgtgccggttgcttgtacagacgggtacggtggcctggtgacaacagacccgaaaacagctgaccctgtttatggtatggtgtacaacccgcccagaaccaactaccctgggcgctttacaaacttgttggacgtggccgaggcttgcccgaccttcctctgttttgacgacgggaaaccttacgttgtgacaaggacggacgaccaacgcctcctggccaagtttgacgtttctcttgctgcaaagcacatgtcaaacacctacctctcagggatagcacagtactacacgcagtactctggcactatcaatctgcatttcatgttcactggctctactgaatcaaaggcccggtacatggtggcgtacattccacctggcatggacaacccaccggacacacctgagaaggctgcacactgcatccacgccgagtgggacaccgggctgaactccaaatttactttttctatcccttacgtgtctgctgcagactacgcatacactgcgtctgacgtggcagaaacaacaaacgtacaggggtgggtctgcatataccaaatcactcacgggaaggctgaacaggacactctggtcgtgtcggtcagcgccggcaaggactttgaactgcgcctcccaattgacccccgcacgcaaaccaccactgccggggagtcagcagaccctgtcaccaccaccgttgagaactacggtggtgagacacaggctcagcgacgtcagcacactgacgtcggcttcatcatggacaggtttgcgaaaatcagccccgtgagccccacgcacgtcattgacctcatgcaaacacaccaacatgcgttggtgggtgcccttttgcgtgcagccacgtactacttctccgatctggagattgtggtgcgtcatgatggcaacttgacgtgggtgcccaatggagcacctgtagaagccttggccaacacaagcaaccccaccgcctaccacaagcagccatttacgagacttgcgctcccttacaccgcgccgcaccgagtgttggcaacagtgtataacggagtaagcaagtactctacaactggtaatggcagaaggggtgatctggggcctcttgcggcgcgggtcgccgcacagctccccagctctttcaattttggtgcaattcgggccacgaccgtccacgagcttctcgtgcgcatgaaacgtgccgagctctactgtccaaggcctctgctggcagtggaagtgttgtcgcaggacagacacaagcaaaagatcattgcacctgcaaagcaactcctgaacttcgacctgctcaagttggcgggagacgttgagtccaaccccgggccc

SEQ ID NO: 140 - DNA, 2277 bp, Artificial Sequence
  SAT2 Egypt 2010 cut sites removed
ggggccgggcaatccagcccggctactggttcccaaaatcaatcaggcaatactggtagcattattaacaactactacatgcaacagtaccagaactcaatggacacacagcttggtgacaacgccattagcggtggttccaacgaggggtcaacggacaccacgtcaacacacacaaacaacacacagaacaatgactggttttccaaattggctcaatcagccatttcagggcttttcggtgctctgcttgcagacaagaaaacagaggagaccacactgctggaggacagaatcctgaccacacgtcacgggaccacgacctccaccacgcaaagttctgtgggagtgacatttggttatgctgatgctgattcgtttcgcccaggaccaaacacctctgggcttgagacgcgcgtgcaacaggcagaacgcttcttcaaggagaaactttttgactggaccagtgacaaacctttcggtacgctgtacgtgttggagttgcccaaagaccacaagggcatctacggtaaacttaccgactcctacacgtacatgcgtaacggttgggacgttcaggtcagcgcgaccagcacacagtttaacggcggatcactgctcgtggcaatggtcccagagttgtgcagtctaaaagccagagaagaatttcaactcactctctacccacaccagttcattaacccgcgcaccaacacaaccgcacacatacaggttccttacctgggtgtaaacagacacgaccagggtaagcgccaccaggcgtggtctctggttgtgatggtgctcacgcctcttaccaccgaggcgcagatgaacagcggcaccgtcgaggtgtacgccaacatcgcaccaacaaatgtggttgtggcgggtgaactgccgggtaagcagggcatcattccggtcgctgccgctgacgggtatggtggtttccagaacaccgacccgaaaacggctgaccccatttacgggcatgtgtacaacccgtccagaaacgactgccacgggcgatactccaatcttatggatgtcgccgaggcgtgtccaacactcctcaactttgatggcaagccctacgtcgtgaccaagaacaacggtgacaaggtgatggcacgcttcgatgtcgcctttacacacaaggtgcatgggaacacgtttctggcgggcttggccgactactacacacagtattcaggcagcctaaactaccacttcatgtacactggacccacacatcacaaggcaaagttcatggtggcatacgtgccccctggtgttgcagttgaccaactgcctagcacaccggaggatgctgcgcactgctaccatgcggaatgggacaccgggttgaactcttctttctcgttcgcagtgccttacatctccgctgcggacttttcttacacacacacagacacaccagcaatggccaccactaatggctgggtagttgtactacaggtcacagacacgcactctgcggaagctgccgttgtagtgtcagtcagcgcgggaccagatttggagttccgattccctatcgaccctgtgcgacagactacctcggcgggagaaggcgcagatgttgtcaccacggacccatcgacacacggtgggaatgttcaagagggacgacgcaaacacaccgacgttgcgttccttcttgatcgcagtacacacgttcacacaaataagacatcttttgttgtggacctcatggacacaagggagaaggcgctcgtaggcgcaatcctgcgagcatccacctactacttttgtgaccttgaaattgcatgtgtgggcgaccacacaagggtcttctggcagcccaacggggcaccacggactacccagctcggcgacaaccctatggtttttgccaagggcggcgtaacccgctttgccatcccgtttacggctccacacaggctgctatctactgtttacaacggcgagtgtgtgtacaccaaggccgccgctgccattcgtggtgatcgtgcggcacttgcggcaaagtacgctgacaccaaccacactttgccgccaaccttcaacttcgggtacgtgaccgttgacaaaccagttgacgtttactaccggatgaagagggctgagctgtactgcccacgcccactgctgccagcctacaaacacacagacagagacagattcgacgcgcccatcggcgtcgaaagacagaccctgaattttgacctgctgaaactggcaggagacgttgagtccaaccctgggccc

SEQ ID NO: 141 - DNA, 2247 bp, Artificial Sequence
  C3 indaial restriction sites removed
ggagccggacaatccagcccggcgactggctcgcagaaccaatctggcaacactggtagcataatcaacaactactacatgcaacagtaccaaaattcaatggacacacaactgggtgacaatgctattagtggtggctccaacgagggctccacagatacaacttccacccacacaaccaacactcaaaacaacgactggttttccaaactcgccagttctgcctttagcggtcttttcggtgctcttcttgccgacaagaagaccgaggaaaccacactacttgaagaccgcatcctcaccacccgcaacggccacacgacttcgacaactcagtcgagcgttggggtcacatacgggtacgcaacaactgaggatagcacgtcagggcctaacacatccggccttgagacacgtgttcaccaggcagaacggtttttcaagatgacactctttgaatgggttccctcccagagttttggacacatgcacaaggtcgttctgccctcagaaccgaaaggtgtctatgggggtctcgtcaagtcttatgcgtacatgcgcaatggctgggacgttgaggtgactgctgttggaaaccagttcaacggcggttgtctcctggtggcgctcgttcctgaaatgggtgacatcagtgacagagagaagtaccaactgactctctacccccaccaattcatcaacccacgcactaacatgacggcacacatcaccgtgccttacgtgggtgtcaacagatacgaccaatacaaccaacacaagccctggactcttgtcgtcatggtcgttgctccacttactgtgaacacatcaggtgcccagcagatcaaggtgtatgccaacatagccccaaccaacgttcacgttgctggtgaacttccctccaaggaggggatcttccccgttgcgtgtgccgacggctatggcaacatggtgacaactgacccgaagacggctgaccctgcctacgggaaagtctataatccacccaggaccgccctgccgggccggttcacaaactacctggatgttgctgaggcttgccccactctcctgacgttcgagaacgtgccttacgtttcaacacggactgatggacaaaggctgttggccaagttcgacgtgtcattggcagcgaaacacatgtcaaacacttacttggctggcttggcccagtactacacacagtacgctgggacaatcaacctgcacttcatgttcactgggccaaccgacgcgaaagctcggtacatggtggcatacgtgccccctggcatggaagcaccagacaacccagaggaggctgcccactgcatacacgcagagtgggacactggtttgaactctaagttcacattttcaatcccgtacatctcggccgctgactacgcatacaccgcgtccagcgaggctgaaacaacaagcgtacagggatgggtttgtgtgtaccagatcactcacggcaaggcagacgctgacgcgctcgtcgtctccgcttcggcggggaaagactttgaactccggctacctgtggacgctagacagcaaactacgaccactggcgaatctgccgaccccgtcaccactaccgttgagaactacggaggagaaacacaaactcaacgtcgccaccacactgacgttgccttcgttcttgatcggtttgtgaaggtccaggtgtcgggcaaccaacacacactggacgttatgcaggtacacaaggacagtattgtgggtgcactcctacgcgcagccacatactacttctctgacttggaaatagcagtgactcacactgggaagctcacatgggtgcccaacggcgccccagtttctgcacttgacaacacaaccaaccccactgcctaccacaaggggccgctgactcggctggctctcccatacaccgcaccacaccgcgtgctggccacggcgtacactggtacaacggcctacactacaggtgtacgcaggggagacctagcccacttggcggcggcgcacgctcggcacctgccaacgtcgttcaactttggtgcagttaaagcagagacaatcacagagctgcttgtgcgcatgaagcgtgctgaactctactgccccaggccggtccttccggtccaaccagcgggcgataggcacaaacaaccgctcattgcgccagcgaaacaactgctgaacttcgaccttctcaagttggcgggagatgtcgagtccaaccctgggccc

SEQ ID NO: 142 - DNA, 2277 bp, Artificial Sequence
  SAT3 ZIM/6/91 restriction sites removed
ggagcgggccagtcttcccctgccactgggtcgcagaaccaatctggcaacactggcagcatcataaacaactactacatgcagcagtaccaaaattcaatggacacccagcttggcgacaacgccatctcgggtggttcaaatgaaggcagcacggacaccacgtccacacacaccaacaacacccaaaacaatgattggttttcaaaattggcccaatccgccatttcaggactcttcggggctctgttggcggacaaaaagaccgaggaaacaaccttgcttgaggaccgaatcctcacaacacgccacaatactaccacatccaccacgcagagttcggtgggagtgacttacggttatgcgtccgctgatcggtttctcccaggaccgaacacaagtgggctggaaacgcgagtggaacaggccgagagattcttcaaggagagactcttcacttggaccgcttcgcagcagtacgcccacgttcacctgcttgaacttcccaccgaccacaagggcatctacggtgcaatggtggacaaccacgcttacatacgcaacggatgggacgtgcaggtctccgcgaccagcacgcagttcaatggtggtacattgctcgtggcaatggtcccagagttacacgcgctcgacacacgtagtgtttcacagctcacgctgtttccacaccaattcatcaacccacgcacaaacaccactgcccacattgtcgttccctacattggggtaaacaggcatgaccaggtaaaaatgcacaaggcctggacattggtggtcgcggttctcgcaccgctcacaacatcaaacatgggacaggacaacgttgaggtgtacgccaacatcgcaccaaccaacgtttttgttgctggcgagaagcctaccaaacaaggcatcttccccgtggcctgcaacgacggctacggtggctttcagaacactgatcccaagacctctgaccccatatacgggcttgtggcaaacccacctcgcaccgcttttccagggaggttcaccaacttccttgacgtggcggaggcatgcccgacctttctggacttcaacggaacaccttacgtcaagaccagacacaacagtgggagcaagatactcacccacatagatttggcttttgggcacaagagtttcaagaacacttatcttgctggtctcgcccagtattacgcccaatacagcggatctctcaacctgcacttcatgtacacgggtccaacgcaatcaaaggcacgctttatggttgcatacgtaccaccagggacggagcccgtaccatcaacacccgaggaagcggcgcactgctaccactcggaatgggacactggactgaactccaagttcacgttcacagtgccgtacatgtctgctgctgactatgcctacacctactgcgacgagcctgaacaggcctccgcacaagggtgggtaacactgtaccaaattactgacacacatgaccctgattcggctgtcctcatctcagttagcgcaggcgctgactttgaactcaggctgcccatcaaccccgttactcagacaacgagcgcgggggaaggcgcagacgtggtgacaacggacgttaccacacatggaggaacagttgacacaccaagaaggcagcacaccaacgtggagtttctgctggacagattcacacacattgggtcgatcaccgcctcaaagaccattgacctccttgagacaaaagaacacacgctggtgggcgcactcctgcgttcagctacgtactacttttgtgaccttgaggtcgcggtgcttggcaacgcgaagtgggttggatgggtgccgaatggctgcccacacaccgaccgcgtggaagacaacccagtcgttcacgccaaggggaatgttacccgctttgcactgccctacacagccccgcacggagtgcttgccacgacctacaacgggacttgcaagtattccaagacgcaaagtgttaaaccacgccgaggcgacatggctgtgctggcacaacgtgttgaaggtgaacaacaaagatgcaaacccacgacattcaacttcggtcgattgttgtgtgattcgggtgacgtgtactaccgaatgaagcgggccgagctttactgcccacgtccgctgatggtcaggtacactcacaccacagacagatacaaagttgcgcttgtgtcaccagctaagcaactgtgcaacttcgacctgttaaagttggctggagatgttgagtccaaccctgggccc

SEQ ID NO: 143 - DNA, 2289 bp, Artificial Sequence
  SAT1 KNP/196/91 restriction sites removed
ggagcgggccagtcgtcccccgccactgggtcacagaaccagtcaggcaacactggcagcatcatcaacaactactacatgcaacagtaccaaaattcaatggacacccaactcggagacaacgccatctccggtgggtcaaatgagggttcgaccgacacaacttcgacccacaccagcaacacccaaaacaacgattggttttcaaaattggctcaatcggccttctctggattggttggtgcgttgcttgccgacaagaagactgaggaaaccacactccttgaggatcgcatcctcacgaccagtcacggcacaaccacctcgaccacacaaagttcagtgggcataacctacggttacgccgactcggaccgtttcctccccggcccaaacaccaacgggctggagacacgtgtggaacaagcagagaggtttttcaaacacaaattatttgattggacacttgaacaacgatttggaacaacacacgttttggaactgcccacagaccacaaaggcatctatggacaacttgttgactcccactcatacattcgcaatgggtgggacgttgaggtctccgcgaccgcaacgcagttcaacgggggctgcctcctggtagcgatggtgcccgaattgtgcaaactgtcggaaagagagaaataccaactcactctcttccctcatcaatttctagacccaaggaccaacaccacggcacacatccaggttccctacctgggcgtggatcgccacgaccaaggaacacgccacaaagcgtggaccctggttgtcatggtggtggcaccctacacaaacgatcagacgattggctcgaacaaagccgaggtgtacgtgaacattgctcccacaaacgtttacgtcgccggtgagaagcccgcaaaacagggcattctccccgtggccgtctccgttggctatggtggcttccaaaatacagatcccaaaacatcggaccccgtatatgggcacgtgtacaacccggctcgcaccggcctacctgggaggttcacaaacctcttggatgtggctgaagcgtgccctacactgcttgacttcaacggagttccgtatgtgaccacccaggcaaactcaggatctaaagtgttaacttgttttgatttggcttttggtcacaaaaatttgaaaaatacatttatgtctggtcttgcccagtactacacccagtacagtggcacactcaacctgcacttcatgtacacaggcccaaccaacaacaaggctaagtacatggtggcctacatcccacctgggacacaccctctcccggaaacaccggagatggagtcccactgtcaccacgccgagtgggacacaggcctgaactcaaccttcacattcaccgtgccgtatgtgtcggctgccgacttcgcgtacacctactctgacgagcctgaacaggcttcggttcagggttgggtgggcgtatatcaggtgactgacacacacgagaaggacggtgcagttgttgtgtccgtcagtgctggacccgacttcgagttcaggatgcccatcagcccctcgcgccagaccacatccgctggcgaaggagcggagcctgtcacgactgatgcttcccaacacggaggcgacagacggacaactcgtaggcatcacactgatgtgagcttcttgctcgatcggttcacactggttggtaaaacacaggacaacaaactgacactagacctgctccaaaccaaggaaaaagcactggttggcgcaatcctgcgcgcagccacgtactacttctctgacttggaggttgcgtgtgtgggtgacaacaaatgggtcggctggactcccaacggtgctccagaacttgcggaagtgggcgacaacccagtcgtcttttccaaaggtagaaccacccgttttgcactgccctacaccgctccacacaggtgcttggcgacagcctacaacggtgactgcaagtacaaacccactggcacagctccacgcgaaaacattcgtggagacctcgcaactctcgcggcgaggattgcaagtgagacacacattccaaccaccttcaactatggcaggatttacacagacactgaggtcgatgtgtacgtcaggatgaagcgcgcggaactctactgcccgcgacccgttctcacgcactacgaccacggtggcagggatcgctacagaactgcgatcaccaaacctgtcaaacagatgtgcagtttcgacctgttaaagctggctggagacgttgagtccaaccctgggccc

SEQ ID NO: 144 - DNA, 2249 bp, Artificial Sequence
  Asia1 Shamir restriction sites removed
ggagccggtcaatccagtccggcaaccgggtcacagaaccaatctggcaacactggaagcatcattaacaactactacatgcaacagtaccagaactcaatggacacacagcttggtgacaacgctattagcggaggttccaacgaaggttccacggataccacttccacacacacaaacaacacccaaaacaacgactggttctcgcgcctggcaagctctgcattcagtggactatttggtgcacttttggctgacaagaagacagaagagacaactctgcttgaagaccgcattctcaccaccaggaacggccacacaacatcgacgacacagtcgagcgttggcgtaacatacggttacgctgtggccgaggacgcggtgtctggacccaatacctcgggactcgagactcgtgttcaacaggcagaacggtttttcaagaaacacctgtttgactggacaccgaacttggcatttggacactgttactacctggaacttcccactgaacacaaaggcgtgtacggcagtctcatgggctcatacgcctacatgagaaatggatgggacatagaggtgactgctgttggaaaccaattcaacggtggttgtctccttgtcgcgctcgtgccagagctgaaggaactcgacacgcgacagaagtaccaactgaccctctttccccaccagttcatcaacccacgcaccaacatgacggcccacatcaacgtgccatacgtgggtatcaacaggtacgaccagtacgccctccacaagccgtggacgcttgttgtgatggtggtagccccactcaccgtcaaaactggtggttctgaacagatcaaggtttacatgaatgcagcgccaacctacgtgcatgtggcgggagagctgccctcgaaagagggaatagttcccgtcgcgtgtgcggacggttacggcaacatggtgacaacggacccgaagacggccgatccagtttacgggaaagtgttcaacccccccaggacaaacctccctgggcgcttcacgaacttccttgatgttgcggaggcatgtccaactttcctccgctttggagaagtaccatttgtgaagacggtgaactctggagaccgcttgctggccaagttcgacgtgtccctcgcagcagggcacatgtccaacacctacttggctggcctggcgcagtactacacacagtacagcggcaccatgaacgtccacttcatgttcaccggacccacggatgctaaagcccgatacatggtggcttatgtcccccctggcatgacaccgcccacggaccctgagcacgccgcacactgcattcactctgagtgggatactggtcttaactctaagtttaccttttccataccttacctctctgctgctgactatgcctacactgcttctgacgtggcggagaccacgagtgtgcagggatgggtgtgtatctatcagatcacccacggcaaggctgagggagacgcactggtcgtttctgtcagcgccggcaaagactttgagtttcgcttgcctgttgacgcacgccagcaaaccaccaccactggcgaatcagcagatccagtcacaaccacggttgagaactatggaggagagactcagacagccagacggcttcacactgacgtcgccttcattcttgacaggtttgtgaaactcactgctcccaagaacatccaaaccctcgatctcatgcagatcccctcacacacgctggttggagcactacttcgttctgcgacgtactacttctcagacctggaggtcgcgcttgtccacacaggcccagtcacctgggtgcccaacggagcgcccaaggatgctctaaacaaccagaccaacccaactgcctatcagaagcaacccatcacccgcctggcactcccctacaccgccccccatcgtgtgctggcaacagtgtacaacgggaagacggcttacggggaaacgacctcaaggcgcggcgacatggcggccctcgcacaaaggttgagcgctcggctgcccacctccttcaactacggcgccgtgaaggccgacaccatcactgagcttttgatccgcatgaagcgcgcggagacatattgccctaggcctttactagcccttgacaccactcaggaccgccgcaaacaggagatcattgcacctgagaagcaggttttgaactttgacctactcaagttggcaggagacgttgagtccaaccccgggcc

SEQ ID NO: 145 - DNA, 558 bp, Gaussia princeps
atgggagtcaaagttctgtttgccctgatctgcatcgctgtggccgaggccaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 146 - DNA, 558 bp, Gaussia princeps
  misc_feature (1)..(558): SGluc luciferase
atgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 147 - DNA, 654 bp, Artificial Sequence
  GLuc_delta1D2A construct
atgggagtcaaagttctgtttgccctgatctgcatcgctgtggccgaggccaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacgctagccacaagcaaaagatcattgcaccagcaaagcagcttctgaattttgacctgctcaagttggccggagacgttgagtccaaccctggacccggg

SEQ ID NO: 148 - DNA, 648 bp, Artificial Sequence
  SGLuc-delta1D2A construct
atgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggttgtaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacagccacaagcaaaagatcattgcaccagcaaagcagcttctgaattttgacctgctcaagttggccggagacgttgagtccaaccctggaccc

SEQ ID NO: 149 - DNA, 654 bp, Artificial Sequence
  Delta 1D2A-GLuc construct
atgagccacaagcaaaagatcattgcaccagcaaagcagcttctgaattttgacctgctcaagttggccggagacgttgagtccaaccctggaccaatgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttcagacctgctcaagaagtggctgccgcaacgctgtgcgacctttgccagcaagatccagggccaggtggacaagatcaagggggccggtggtgactaa

SEQ ID NO: 150 - DNA, 654 bp, Artificial Sequence
  Delta1D2A-SGluc construct
atgagccacaagcaaaagatcattgcaccagcaaagcagcttctgaattttgacctgctcaagttggccggagacgttgagtccaaccctggaccaatgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaa

SEQ ID NO: 151 - DNA, 651 bp, Artificial Sequence
  Delta1D2A-Gluc delta-IM Construct
atgagccacaagcaaaagatcattgcaccagcaaagcagcttctgaattttgacctgctcaagttggccggagacgttgagtccaaccctgggcccggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttcagacctgctcaagaagtggctgccgcaacgctgtgcgacctttgccagcaagatccagggccaggtggacaagatcaagggggccggtggtgactaa

SEQ ID NO: 152 - DNA, 651 bp, Artificial Sequence
  Delta1D2A-SGluc delta IM construct
atgagccacaagcaaaagatcattgcaccagcaaagcagcttctgaattttgacctgctcaagttggccggagacgttgagtccaaccctgggcccggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttcagacctgctcaagaagtggctgccgcaacgctgtgcgacctttgccagcaagatccagggccaggtggacaagatcaagggggccggtggtgactaa

SEQ ID NO: 153 - DNA, 3724 bp, Artificial Sequence
  mp-target-SGluc construct
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagcttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccacgcgtgattttggcgcgccgccaccatgggagtcaaagttctgtttgccctgatctgcatcgctgtggccgaggccaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgaccttctcaagaagtggctgccgcaacgctgtgcgacctttgccagcaagatccagggccaggtggacaagatcaagggggccggtggtgactaacccggggcaaaatcagcctcaatctttcccgggttaatgcttcgagaagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgactcgagtggcacttttcggggaaatgtgcgcggaacccctatttgtttatttttctaaatacattcaaatatgtatccgctctcgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgtcagaccaagtttactcatatatactttagattgatttaaaacttcatttttaatttaaaaggatctaggtgaagatcctttttgataatctcatgaccaaaatcccttaacgtgagttttcgttccactgagcgggtaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 154 - DNA, 6698 bp, Artificial Sequence
  mpTarget P1-3C-delta1D2A-SGLuc construct
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagcttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagggatccgccgccgccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagaaggcagaattcagccacaagcaaaagatcattgcaccagcaaagcagcttctgaattttgacctgctcaagttggccggagacgttgagtccaaccctggaccaatgggagtcaaagttctgtttgccctgatctgcatcgctgtggccgaggccaagcccaccgagaacaacgaagacttcaacatcgtggccgtggccagcaactttgcgaccacggatctcgatgctgaccgagggaagttgcccggcaagaagctgccgctggaggtgctcaaagagatggaagccaatgcccggaaagctggctgcaccaggggctgtctgatctgcctgtcccacatcaagtgcacgcccaagatgaagaagtggctcccaggacgctgccacacctacgaaggcgacaaagagtccgcacagggcggcataggcgaggcgatcgtcgatattcctgagattcctgggttcaaggacttggagccaatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaacccgggttaatgcttcgagaagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgactcgagtggcacttttcggggaaatgtgcgcggaacccctatttgtttatttttctaaatacattcaaatatgtatccgctctcgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgtcagaccaagtttactcatatatactttagattgatttaaaacttcatttttaatttaaaaggatctaggtgaagatcctttttgataatctcatgaccaaaatcccttaacgtgagttttcgttccactgagcgggtaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 155 - DNA, 6043 bp, Artificial Sequence
  mpTarget P1-3C construct
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaagcttaagctgcagtgactctcttaaggtagccttgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacagggatccgccgccgccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaaccctgggcccagcggccgcatgagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtaggaattcccgggttaatgcttcgagaagacatgataagatacattgatgagtttggacaaaccacaacaagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaatccgataaggatcgactcgagtggcacttttcggggaaatgtgcgcggaacccctatttgtttatttttctaaatacattcaaatatgtatccgctctcgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgtcagaccaagtttactcatatatactttagattgatttaaaacttcatttttaatttaaaaggatctaggtgaagatcctttttgataatctcatgaccaaaatcccttaacgtgagttttcgttccactgagcgggtaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 156 - protein, 10 aa, Foot-and-mouth disease virus
  MISC_FEATURE (8)..(8): Xaa at position 8 is D or E
GRLIFSGXAL

SEQ ID NO: 157 - protein, 13 aa, Artificial Sequence
  Beta ribbon FMDV 3C protease
  MISC_FEATURE (2)..(2): Xaa at position 2 is I or L
DXVVCMDGDTMPF

SEQ ID NO: 158 - protein, 10 aa, Artificial Sequence
  B1 beta strand FMDV 3C protease
  MISC_FEATURE (5)..(5): Xaa at position 5 is I or L
KTVAXCCATF

SEQ ID NO: 159 - protein, 4 aa, Artificial Sequence
  Residues 140-143 FMDV 3C protease
VVCM

SEQ ID NO: 160 - protein, 4 aa, Artificial Sequence
  Residues 27 to 30 of FMDV 3C protease
TVAI

SEQ ID NO: 161 - DNA, 13 bp, Artificial Sequence
  Kozak consensus sequence.  "r" is g or a
gccgccrccatgg

SEQ ID NO: 162 - DNA, 13 bp, Artificial Sequence
  Kozak sequence
gccgccgccatgg

SEQ ID NO: 163 - DNA, 32 bp, Artificial Sequence
  Primer 3CLeb89 V28K-MF
cttgacggtaagacgaaggccatctgctgcgc

SEQ ID NO: 164 - DNA, 32 bp, Artificial Sequence
  Primer 3CLeb89 V28K-MR
gcgcagcagatggccttcgtcttaccgtcaag

SEQ ID NO: 165 - DNA, 32 bp, Artificial Sequence
  3CLeb89 V141T-MF primer
tacaaggacattgtaacgtgcatggatggaga

SEQ ID NO: 166 - DNA, 32 bp, Artificial Sequence
  3CLeb89 V141T-MR primer
tctccatccatgcacgttacaatgtccttgta

SEQ ID NO: 167 - DNA, 32 bp, Artificial Sequence
  3C C142T-MF primer
aaggacattgtagtgaccatggatggagacac

SEQ ID NO: 168 - DNA, 32 bp, Artificial Sequence
  3C C142T-MR primer
gtgtctccatccatggtcactacaatgtcctt

SEQ ID NO: 169 - DNA, 32 bp, Artificial Sequence
  3C C163A-MF primer
accaaggctggctacgctggaggagccgttct

SEQ ID NO: 170 - DNA, 32 bp, Artificial Sequence
  3C C163A-MR primer
agaacggctcctccagcgtagccagccttggt

SEQ ID NO: 171 - DNA, 31 bp, Artificial Sequence
  3C L127P-MF primer
ccgacgttgggagaccgattttctccggtga

SEQ ID NO: 172 - DNA, 31 bp, Artificial Sequence
  3C L127P-MR primer
tcaccggagaaaatcggtctcccaacgtcgg

SEQ ID NO: 173 - DNA, 28 bp, Artificial Sequence
  NotI-3CLeb89-F primer
cagcggccgcatgagtggtgccccaccg

SEQ ID NO: 174 - DNA, 27 bp, Artificial Sequence
  DNA, 3C-NotI-R primer
tagcggccgctactcgtggtgtggttc

SEQ ID NO: 175 - DNA, 26 bp, Artificial Sequence
  H3-F primer
aaggagctcgagccaccatggctcgt

SEQ ID NO: 176 - DNA, 23 bp, Artificial Sequence
  H3-R primer
ggttaccttaagcacgttctcca

SEQ ID NO: 177 - DNA, 33 bp, Artificial Sequence
  SGluc8990-MF primer
ccaagatgaagaagtggctcccaggacgctgcc

SEQ ID NO: 178 - DNA, 33 bp, Artificial Sequence
  SGluc8990-MR primer
ggcagcgtcctgggagccacttcttcatcttgg

SEQ ID NO: 179 - DNA, 20 bp, Artificial Sequence
  T7 primer
taatacgactcactataggg

SEQ ID NO: 180 - DNA, 24 bp, Artificial Sequence
  Seq-R primer
ttacgccaagttatttaggtgaca

SEQ ID NO: 181 - DNA, 28 bp, Artificial Sequence
  Gluc-NS-NheI-R primer
cggcgctagcgtcaccaccggccccctt

SEQ ID NO: 182 - DNA, 28 bp, Artificial Sequence
  AscI-Kzk-Gluc-F primer
ttggcgcgccgccaccatgggagtcaaa

SEQ ID NO: 183 - DNA, 24 bp, Artificial Sequence
  XmaI-3C-F primer
tacccgggccgagtggtgccccac

SEQ ID NO: 184 - DNA, 21 bp, Artificial Sequence
  3Casia-ns-EcoRI-R primer
gaattcctcgtggtgtggttc

SEQ ID NO: 185 - DNA, 29 bp, Artificial Sequence
  AscI-Kzk-2A-F primer
gcgccgccaccatgagccacaagcaaaag

SEQ ID NO: 186 - DNA, 26 bp, Artificial Sequence
  Gluc-R-NotI primer
gcggccgcttagtcaccaccggcccc

SEQ ID NO: 187 - DNA, 30 bp, Artificial Sequence
  No Met Gluc-MF primer
tccaaccctgggcccggagtcaaagttctg

SEQ ID NO: 188 - DNA, 30 bp, Artificial Sequence
  No Met Gluc-MR primer
cagaactttgactccgggcccagggttgga

SEQ ID NO: 189 - DNA, 24 bp, Artificial Sequence
  N-terminal FLAG Tag
  CDS (1)..(24)
gactataaggacgacgacgacaag

SEQ ID NO: 190 - protein, 8 aa, Artificial Sequence
  Synthetic Construct
DYKDDDDK

SEQ ID NO: 191 - DNA, 18 bp, Artificial Sequence
  His-6 tag
  CDS (1)..(18): Histidine-6 tag
catcatcaccatcaccac

SEQ ID NO: 192 - protein, 6 aa, Artificial Sequence
  Synthetic Construct
HHHHHH

SEQ ID NO: 193 - protein, 8 aa, Artificial Sequence
  Conserved 2A motif
  misc_feature (2)..(2): Xaa can be any naturally occurring amino acid
  misc_feature (4)..(4): Xaa can be any naturally occurring amino acid
DXEXNPGP

SEQ ID NO: 194 - DNA, 639 bp, Foot-and-mouth disease virus
  CDS (1)..(639)
agtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagactgattttctccggtgaggccctcacctacaaggacattgtagtgtgcatggatggagacaccatgccgggcctatttgcctacagagccgctaccaaggctggctacgctggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgag

SEQ ID NO: 195 - protein, 213 aa, Foot-and-mouth disease virus
SGAPPTDLQKMVMSNTKPVELILDGKTVAICCATGVFGTAYLVPRHLFAEKYDRIMLDGRAMTDSDYRVFEFEIKVKGQDMLSDAALMVLHRGNRVRDITKHFRDTARMKKGTPVVGVINNADVGRLIFSGEALTYKDIVVCMDGDTMPGLFAYRAATKAGYAGGAVLAKDGADTFIVGTHSAGGNGVGYCSCVSRSMLLKMKAHIDPEPHHE

SEQ ID NO: 196 - DNA, 25 bp, Artificial Sequence
  2A-XmaI-R primer
tatacccgggtccagggttggactc

SEQ ID NO: 197 - DNA, 33 bp, Artificial Sequence
  GLuc8990-MF-2 primer
ccaagatgaagaagttcatcccaggacgctgcc

SEQ ID NO: 198 - DNA, 33 bp, Artificial Sequence
  Gluc8990-MR-2 primer
ggcagcgtcctgggatgaacttcttcatcttgg

SEQ ID NO: 199 - DNA, 23 bp, Artificial Sequence
  3CLeb89-EcoR1-R primer
gaattcctactcgtggtgtggtt

SEQ ID NO: 200 - DNA, 558 bp, Gaussia princeps; identical to SEQ ID NO: 145
  CDS (1)..(558): GLuc

SEQ ID NO: 201 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 202 - DNA, 558 bp, Gaussia princeps; identical to SEQ ID NO: 146
  CDS (1)..(558): SGLuc

SEQ ID NO: 203 - protein, 185 aa, Gaussia princeps
MGVKVLFALICIAVAEAKPTENNEDFNIVAVASNFATTDLDADRGKLPGKKLPLEVLKEMEANARKAGCTRGCLICLSHIKCTPKMKKWLPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 204 - DNA, 33 bp, Artificial Sequence
  His-tag
  CDS (1)..(33)
atgggcagcagccatcatcatcatcatcacggc

SEQ ID NO: 205 - protein, 11 aa, Artificial Sequence
  Synthetic Construct
MGSSHHHHHHG

SEQ ID NO: 206 - protein, 30 aa, Artificial Sequence
  Delta 1D2A motif
  MISC_FEATURE (1)..(1): Xaa 1 is H, R, Y or D (Xaa at position 1)
  MISC_FEATURE (2)..(2): Xaa 2 is K or R
  MISC_FEATURE (3)..(3): Xaa 3 is Q, T. F or V.
  MISC_FEATURE (4)..(4): Xaa 4 is E, K, P, A or D
  MISC_FEATURE (5)..(5): Xaa 5 is I, P, L or A
  MISC_FEATURE (6)..(6): Xaa 6 is I, T or V
  MISC_FEATURE (7)..(7): Xaa 7 is A, K, G or S
  MISC_FEATURE (8)..(8): Xaa 8 is P or V
  MISC_FEATURE (9)..(9): Xaa 9 is E, A or V
  MISC_FEATURE (10)..(10): Xaa 10 is K or R
  MISC_FEATURE (12)..(12): Xaa 12 is V, L, M or T
  MISC_FEATURE (13)..(13): Xaa 13 is L or C
  MISC_FEATURE (14)..(14): Xaa 14 is N or S
XXXXXXXXXXQXXXFDLLKLAGDVESNPGP

SEQ ID NO: 207 - protein, 17 aa, Artificial Sequence
  2A motif
  MISC_FEATURE (1)..(1): Xaa at position 1 is A, V, I, L, M, or T
  MISC_FEATURE (2)..(2): Xaa at position 2 is T, S, L or C
  MISC_FEATURE (3)..(3): Xaa at position 3 is N or S
  MISC_FEATURE (4)..(4): Xaa at position 4 is F or K
  MISC_FEATURE (5)..(5): Xaa at position 5 is D, S or E
  MISC_FEATURE (8)..(8): Xaa at position 8 is K, Q or L
  MISC_FEATURE (9)..(9): Xaa at position 9 is Q, R or L
  MISC_FEATURE (13)..(13): Xaa at position 13 is V or I
  MISC_FEATURE (15)..(15): Xaa at position 15 is T, C or S
XXXXXLLXXAGEXNPGP

SEQ ID NO: 208 - protein, 10 aa, Artificial Sequence
  2A motif
  MISC_FEATURE (4)..(4): Xaa at position 4 is V or I
  MISC_FEATURE (6)..(6): Xaa at position 6 is T, C or S
AGDXEXNPGP

SEQ ID NO: 209 - DNA, 639 bp, Foot-and-mouth disease virus; identical to SEQ ID NO: 194
  misc_feature (1)..(639): C163A variant of Asia Lebanon 89 3C Protease
  CDS (1)..(639)

SEQ ID NO: 210 - protein, 213 aa, Foot-and-mouth disease virus; identical to SEQ ID NO: 195

SEQ ID NO: 211 - protein, 14 aa, Artificial Sequence
  Motif.  X is any amino acid.
  misc_feature (3)..(4): Xaa can be any naturally occurring amino acid
  misc_feature (8)..(8): Xaa can be any naturally occurring amino acid
  misc_feature (10)..(10): Xaa can be any naturally occurring amino acid
LLXXAGDXEXNPGP

SEQ ID NO: 212 - protein, 8 aa, Artificial Sequence
  Motif.  X is any amino acid.
  misc_feature (2)..(2): Xaa can be any naturally occurring amino acid
  misc_feature (4)..(4): Xaa can be any naturally occurring amino acid
DXEXNPGP

SEQ ID NO: 213 - protein, 218 aa, Artificial Sequence
  Fusion protein: GLuc delta1D2A construct
MGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDASHKQKIIAPAKQLLNFDLLKLAGDVESNPGPG

SEQ ID NO: 214 - protein, 218 aa, Artificial Sequence
  Fusion protein: SGLuc delta1D2A construct
MGVKVLFALICIAVAEAKPTENNEDFNIVAVASNFATTDLDADRGKLPGKKLPLEVLKEMEANARKAGCTRGCLICLSHIKCTPKMKKWLPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDASHKQKIIAPAKQLLNFDLLKLAGDVESNPGPG

SEQ ID NO: 215 - protein, 217 aa, Artificial Sequence
  Fusion protein:  Delta 1D2A-GLuc construct
MSHKQKIIAPAKQLLNFDLLKLAGDVESNPGPMGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 216 - protein, 217 aa, Artificial Sequence
  Fusion protein:  Delta1D2A-SGluc construct
MSHKQKIIAPAKQLLNFDLLKLAGDVESNPGPMGVKVLFALICIAVAEAKPTENNEDFNIVAVASNFATTDLDADRGKLPGKKLPLEVLKEMEANARKAGCTRGCLICLSHIKCTPKMKKWLPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 217 - protein, 216 aa, Artificial Sequence
  Fusion protein:  Delta1D2A-Gluc delta-1M construct
MSHKQKIIAPAKQLLNFDLLKLAGDVESNPGPGVKVLFALICIAVAEAKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 218 - protein, 216 aa, Artificial Sequence
  Fusion protein:  Delta1D2A-SGluc delta 1M construct
MSHKQKIIAPAKQLLNFDLLKLAGDVESNPGPGVKVLFALICIAVAEAKPTENNEDFNIVAVASNFATTDLDADRGKLPGKKLPLEVLKEMEANARKAGCTRGCLICLSHIKCTPKMKKWLPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 219 - DNA, 7632 bp, Artificial Sequence
  DNA construct:  pET His-O1P1
caaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatatacatatgggcagcagccatcatcatcatcatcacggcagcggcctggtgccgcgcggcagcgctggatccgccgccgccatgggagccgggcaatccagcccggcaaccgggtcacagaaccaatcaggcaacactgggagcatcatcaacaattactacatgcagcagtaccaaaactctatggacacacaacttggtgacaacgctacaagcggaggctcaaacgaggggtccacggacacaacctccacccacacaaccaacactcagaacaacgactggttctcgaagctggccagttccgctttcagcggtcttttcggcgctcttctcgccgacaagaaaaccgaggagaccactcttcttgaggaccgcatcctcactactcgtaacggacacaccacctcgacaacccagtcgagcgtaggagtcacatacgggtatgcaacggctgaggatttcgtgagcgggccaaacacctctggtcttgagaccagggttgcccaggcagagcggttctttaaaacccacctgttcgactgggtcacaagtgacccgttcggacggtgccacctgctagaacttccaactgaccacaaaggtgtctatggcagcctgaccgactcgtatgcttatatgaggaacggctgggatgttgaagtcactgctgtgggaaatcagttcaatggaggatgcctgttggtggctatggtgccagaactttgctccatacagaagagggagctgtaccagctcacgctctttcctcaccagttcatcaaccctcggacgaacatgacagcacacatcactgtgccctttgttggcgtcaaccgttatgaccagtacaaggtacacaaaccttggaccctcgtggttatggttgtagcccccctgaccgtcaacagtgaaggtgccccgcaaatcaaggtgtatgccaacatcgcacctaccaacgtacacgtcgcgggtgagttcccttccaaagaggggatcttccctgtggcttgcagcgatggttatggcggtctggtgacaactgacccgaaaacggctgaccccgcttacgggaaagtgtttaaccccccccgcaacatgttgccggggcggttcaccaattttcttgacgtggctgaggcgtgccccacgtttctccacttcgagggtgacgtgccatacgtgaccacgaagacggattcagacagggtgctcgctcagttcgacttgtctttggcagcaaagcacatgtccaacaccttccttgcaggtctcgcccagtactacacacagtacagcggcaccatcaacctgcacttcatgttcacagggcctactgacgcgaaggcgcgttacatgattgcgtatgctcctcctggcatggaaccacctaaaacgccagaggcggctgcccactgcatccatgctgaatgggacacagggttgaactcaaaattcacattttcaatcccttacctttcggcggctgattacgcttacacagcgtctgacactgctgagaccacaaatgtacagggatgggtttgcctgtttcaaataacacacgggaaagctgacggcgacgcactggtcgttttggccagcgccggaaaggactttgagctgcgcctgccggtggatgctcgcacacagactacctcagcgggcgagtcagcagaccccgtgaccgccaccgttgagaattacggtggcgagacacaggtccagaggcgccaacacacggacgtgtcatttatattagacagatttgtgaaagtgacaccaaaagaccaaattaatgtattggacctgatgcaaacccctgctcacactttggtgggagcactccttcgtactgccacttactatttcgctgacttagaggtggcagtgaagcacgagggaaacctcacctgggtgccgaacggggcgcctgaagcggcgttggacaacaccaccaacccaacagcttaccacaaggcaccactcacccgacttgcactgccttacacggcgccacaccgcgtgttggctactgtttacaacgggaacagcaagtatggtgacggcacggtggccaatgtgagaggtgatctgcaagtgttggcccagaaggcggcgagagcgctgcctacctccttcaactacggtgccattaaagctactcgggtgactgaactgctttaccgcatgaagagggctgagacatactgtccccggcctcttttggccattcacccggaccaggctagacacaagcagaagattgtggctccggtgaaacagcttctaaattttgacctgctcaaattggcgggagatgtggagtccaacccggggcccagcggccgcagacaagcttaggtatttattcggcgcaaagtgcgtcgggtgatgctgccaacttagtcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatg

SEQ ID NO: 220 - DNA, 6590 bp, Artificial Sequence
  DNA construct:  pSNAP Flag-3C(L127P)
aactacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgtttcccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaccccggttgataatcagaaaagccccaaaaacaggaagattgtataagcaaatatttaaattgtaaacgttaatattttgttaaaattcgcgttaaatttttgttaaatcagctcattttttaaccaataggccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagctatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgcagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagccgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgccggcatgccgccctttcgtcttcaagaattaattcccaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattaattccccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggaattggggatcggaattaattcccggtttaaaccggggatctcgatcccgcgaaattaatacgactcactataggggaattgtgagcggataacaattcccctctagaaataattttgtttaactttaagaaggagatatacatatggactataaagacgacgacgacaaacccgggagtggtgccccaccgaccgacttgcaaaagatggtcatgagcaacactaagcctgttgagctcatccttgacggtaagacggtggccatctgctgcgccaccggagtgtttggtactgcctacctcgtgcctcgtcaccttttcgcagaaaagtacgacaggatcatgttggacggcagggccatgacagacagtgactacagagtgtttgagtttgagattaaagtaaaaggacaggacatgctctcagacgctgcgctcatggtgctccaccgtggcaaccgtgtgagagacatcacgaaacactttcgtgatacagcaagaatgaagaaaggtacccccgttgtcggcgtgatcaacaacgccgacgttgggagaccgattttctccggtgaggccctcacctacaaggacattgtagtgtgcatggatggagacaccatgccgggcctatttgcctacagagccgctaccaaggctggctactgtggaggagccgttcttgccaaggacggagctgacacatttatcgtcggcactcactccgcaggaggcaatggagtcgggtactgctcatgcgtatctaggtccatgctcttgaagatgaaggcacacattgaccccgaaccacaccacgagtagtcgacagacaagcttaggtatttattcggctcgaggttaattaagcggccgcattgatccggctgctaacaaagcccgaaaggaagctgagttggctgctgccaccgctgagcaataactagcataaccccttggggcctctaaacgggtcttgaggggttttttgctgaaaggaggaactatatccggat

What is claimed:

1. A polynucleotide that encodes a modified foot-and-mouth disease (FMDV) 3C protease, wherein the modified FMDV 3C protease comprises an amino acid substitution of L127 of a wild-type FMDV 3C protease.

2. The polynucleotide of claim 1 that encodes a modified FMDV 3C protease comprising residues H46, D84 and C163.

3. The polynucleotide of claim 1 that encodes a modified FMDV 3C protease comprising residue R126.

4. The polynucleotide of claim 1 that encodes a modified FMDV 3C protease comprising residue A133.

5. The polynucleotide of claim 1, wherein the modified FMDV 3C protease is at least 95% identical to at least one wild-type FMDV 3C protease from a FMDV O serotype, A serotype, C serotype, Asia 1 serotype, SAT1 serotype, SAT2 serotype, or SAT3 serotype.

6. The polynucleotide of claim 1 that is at least 95% identical to the FMDC 3C protease polynucleotide sequence selected from the group consisting of SEQ ID NOS: 1, 3, 5, 7, 9, 11, 13, 15, 17, and 19.

7. The polynucleotide of claim 1, wherein the encoded modified FMDV 3C protease is at least 95% identical to the FMDV 3C protease amino acid sequence selected from the group consisting of SEQ ID NOS: 2, 4, 6, 8, 10, 12, 14, 16, 18, and 20.

8. The polynucleotide of claim 1, comprising the polynucleotide sequence of at least one of SEQ ID NO: 121 or SEQ ID NO: 122.

9. The polynucleotide of claim 1, wherein the modified FMDV 3C protease further comprises one or more amino acid substitutions within residues 26-35 of the wild-type FMDV 3C protease.

10. The polynucleotide of claim 9, comprising an amino acid substitution of wild-type residue 28.

11. The polynucleotide of claim 9, comprising the V28K substitution.

12. The polynucleotide of claim 9, wherein the wild-type FMDV 3C protease sequence of residues 26-35 comprises the sequence corresponding to residues 26-35 of SEQ ID NO: 2 (KTVAICCATG) or the sequence corresponding to residues 26-35 of SEQ ID NO: 18 (KTVALCCATG).

13. The polynucleotide of claim 1, wherein residues 125-134 of the wild-type FMDV 3C protease is GRLIFSG(D/E)AL (SEQ ID NO: 156).

14. The polynucleotide of claim 1, wherein the modified FMDV 3C protease comprises the L127P substitution.

15. The polynucleotide of claim 14, wherein the wild-type FMDV 3C protease sequence of residues 125-134 is GRLIFSG(D/E)AL (SEQ ID NO: 156).

16. The polynucleotide of claim 1, (i) selected from the group of polynucleotide sequences described by SEQ ID NO: 21, 23, 25, 27, 29, 31, 33, 35, 37, and 39 or (ii) selected from the group of polynucleotides encoding the amino acid sequences of SEQ ID NO: 22, 24, 26, 28, 30, 32, 34, 36, 38 and 40.

17. The polynucleotide of claim 1, wherein the modified FMDV 3C protease further comprises one or more substitutions within amino acid residues 138-150 of a wild-type FMDV 3C protease.

18. The polynucleotide of claim 17, wherein the wild-type FMDV 3C protease sequence of residues 138-150 comprises the sequence corresponding to residues 138-150 of SEQ ID NO: 2 (DIVVCMDGDTMPG) or the sequence corresponding to residues 138-150 of SEQ ID NO: 18 (DLVVCMDGDTMPG).

19. The polynucleotide of claim 1, wherein the modified FMDV 3C protease further comprises a C142 substitution.

20. The polynucleotide of claim 1 further comprising one or more amino acid substitutions selected from C142L, C142A, C142T, C142V, C142S or an amino acid substitution within residue 31.

21. The polynucleotide of claim 19, comprising the polynucleotide selected from the group consisting of SEQ ID NO: 81, 83, 85, 87, 89, 91, 93, 95, 97, and 99 or from the group consisting of polynucleotides encoding SEQ ID NO: 82, 84, 86, 88, 90, 92, 94, 96, 98 and 100.

22. The polynucleotide of claim 1, wherein the polynucleotide further comprises one or more amino acid substitutions within residues 26-35, 125, 126, 128-134 or 138-150 of a wild-type FMDV 3C protease.

23. The polynucleotide of claim 1, with the proviso that the modified FMDV 3C protease contains a cysteine residue at position 51.

24. The polynucleotide of claim 1, with the proviso that the modified FMDV 3C protease contains a cysteine residue at position 163.

25. The polynucleotide of claim 1 that further comprises at least one polynucleotide sequence encoding a FMDV P1 precursor polypeptide.

26. The polynucleotide of claim 25, wherein the modified FMDV 3C protease comprises the C142T substitution.

27. The polynucleotide of claim 1, wherein the modified foot-and-mouth disease (FMDV) 3C protease further comprises one or more amino acid substitutions at residues V28, V141 or C142, and which further encodes an FMDV P1 precursor polypeptide.

28. The polynucleotide of claim 1, wherein the polynucleotide further encodes at least one of GLuc or SGLuc, and at least one of 2A or Δ1D2A.

29. A vector or polynucleotide construct comprising the polynucleotide of claim 28.

30. A host cell comprising the vector or polynucleotide construct of claim 29, wherein said host cell expresses the modified FMDV 3C protease and the at least one of GLuc or SGLuc.

31. The polynucleotide of claim 28, wherein the polynucleotide comprises an open reading frame encoding at least one of Gluc or SGLuc, at least one of 2A or Δ1D2A, and the modified FMDV 3C protease.

32. A vector or polynucleotide construct comprising the polynucleotide of claim 31.

33. A host cell comprising the vector or polynucleotide construct of claim 32, wherein said host cell expresses the modified FMDV 3C protease and the at least one of GLuc or SGLuc.

34. The polynucleotide of claim 28, comprising the polynucleotide sequence of at least one of SEQ ID NO: 147-152.

35. The polynucleotide of claim 28, wherein the polynucleotide further encodes at least one FMDV P1 precursor polypeptide.

36. A vector or polynucleotide construct comprising the polynucleotide of claim 35.

37. A host cell comprising the vector or polynucleotide construct of claim 36, wherein said host cell expresses the modified FMDV 3C protease, the at least one FMDV P1 precursor polypeptide, and the at least one of GLuc or SGLuc.

38. The polynucleotide of claim 35, wherein the polynucleotide comprises an open reading frame encoding at least one FMDV P1 precursor polypeptide, at least one of Gluc or SGLuc, at least one of 2A or Δ1D2A, and the modified FMDV 3C protease.

39. A vector or polynucleotide construct comprising the polynucleotide of claim 38.

40. A host cell comprising the vector or polynucleotide construct of claim 39, wherein said host cell expresses the modified FMDV 3C protease, the at least one FMDV P1 precursor polypeptide, and the at least one of GLuc or SGLuc.

41. The polynucleotide of claim 35, comprising the polynucleotide sequence of SEQ ID NO: 131 or SEQ ID NO: 135.

42. The polynucleotide of claim 1 that is expressible in a eukaryotic cell.

43. A vector or polynucleotide construct comprising the polynucleotide of claim 1.

44. The vector or polynucleotide construct of claim 43, further comprising a polynucleotide encoding at least one protein or polypeptide of interest in addition to the modified FMDV 3C protease.

45. The vector or polynucleotide construct of claim 43, further comprising at least one promoter or other transcription regulatory element, at least one prokaryotic or eukaryotic translation initiation sequence or other translation regulatory element, at least one translational interrupter sequence, or at least one reporter gene operatively linked to the polynucleotide sequence encoding the modified FMDV 3C protease or another protein of interest encoded by polynucleotides in said vector.

46. The vector or polynucleotide construct of claim 43, further comprising a polynucleotide encoding at least one FMDV protein in addition to the modified FMDV 3C protease.

47. The vector or polynucleotide construct of claim 43, further comprising at least one polynucleotide sequence encoding VP0, VP3, VP1.

48. The vector or polynucleotide construct of claim 43, further comprising a polynucleotide encoding at least one FMDV P1 precursor polypeptide.

49. The vector or polynucleotide construct of claim 43, further comprising at least one polynucleotide sequence encoding a FMDV P1 precursor polypeptide from a FMDV O serotype, A serotype, C serotype, Asia 1 serotype, SAT1 serotype, SAT2 serotype or SAT3 serotype.

50. The vector or polynucleotide construct of claim 43, further comprising at least one polynucleotide sequence encoding a FMDV P1 precursor polypeptide described by SEQ ID NOS: 102, 104, 106, 108, 110, 112, 114, 116 or 118, or encoding a FMDV P1 precursor polypeptide that has a polynucleotide sequence at least 95% identical to SEQ ID NOS: 101, 103, 105, 107, 109, 111, 113, 115, or 117.

51. The vector or polynucleotide construct of claim 43 that expresses the modified FMDV 3C protease and a FMDV P1 precursor polypeptide in a eukaryotic cell.

52. The vector or polynucleotide construct of claim 43 that expresses the modified FMDV 3C protease and a FMDV P1 precursor polypeptide in *Saccharomyces cerevisiae, Pichia pastoris*, or another yeast or fungus cell.

53. The vector or polynucleotide construct of claim 43 that expresses the modified FMDV 3C protease and a FMDV P1 precursor polypeptide in *Arabidopsis thaliana, Chlamydomonas reinhardtii, Glycine max, Nicotiana benthamiana, Nicotiana tabacum, Oryza sativa, Zea mays* or another plant cell.

54. The vector or polynucleotide construct of claim 43 that expresses the modified FMDV 3C protease and a FMDV P1 precursor polypeptide in *Spodoptera frugiperda, Drosophila melanogaster*, Sf9, Sf21, or another insect cell.

55. The vector or polynucleotide construct of claim 43 that expresses the modified FMDV 3C protease and a FMDV P1 precursor polypeptide in a vertebrate cell.

56. The vector or polynucleotide construct of claim 43 that expresses the modified FMDV 3C protease and a FMDV P1 precursor polypeptide in HEK-293-T (human kidney embryo) cell, LF-BK (porcine cell), LF-BK αV/β6 cell, or another mammalian cell.

57. The vector or polynucleotide construct of claim 43 that expresses the modified FMDV 3C protease and a FMDV P1 precursor polypeptide in a cell from a mammal or other animal susceptible to FMDV infection.

58. The vector or polynucleotide construct of claim 43 that expresses the modified FMDV 3C protease and a FMDV P1 precursor polypeptide in a prokaryotic cell.

59. The vector or polynucleotide construct of claim 43 that expresses the modified FMDV 3C protease and FMDV P1 precursor polypeptide in *Bacillus, Lactococcus, Streptomyces, Rhodococcus, Corynebacterium, Mycobacterium* or in another gram-positive prokaryote.

60. The vector or polynucleotide construct of claim 43 that expresses the modified FMDV 3C protease and a FMDV P1 precursor polypeptide in *Escherichia, Pseudomonas* or in another gram-negative prokaryote.

61. The vector or polynucleotide construct of claim 43 that is a minicircle vector, a replication deficient adenovirus vector, a vaccinia virus vector, or other viral vector that expresses the modified FMDV 3C protease and, optionally, a FMDV P1 precursor polypeptide or other protein of interest besides the modified FMDV 3C protease in a host cell.

62. A host cell comprising the vector or polynucleotide construct of claim 43, wherein said host cell expresses the modified FMDV 3C protease.

63. The host cell of claim 62, wherein the vector or polynucleotide construct further comprises at least one promoter or other transcription regulatory element, at least one prokaryotic or eukaryotic translation initiation sequence or other translation regulatory element, at least one translational interrupter sequence, or at least one reporter gene operatively linked to the polynucleotide sequence encoding the modified FMDV 3C protease or another protein of interest encoded by polynucleotides in said vector.

64. The host cell of claim 62, wherein the vector or polynucleotide construct further comprises a polynucleotide encoding at least one protein or polypeptide of interest in addition to the modified FMDV 3C protease.

65. The host cell of claim 62, wherein the vector or polynucleotide construct further comprises a polynucleotide encoding at least one FMDV protein in addition to the modified FMDV 3C protease.

66. The host cell of claim 62, wherein the vector or polynucleotide construct further comprises at least one polynucleotide sequence encoding VP0, VP3, VP1 and, optionally, 2A, Δ1D2A, GLuc and/or SGLuc.

67. The host cell of claim 62, wherein the vector or polynucleotide construct further comprises a polynucleotide encoding at least one FMDV P1 precursor polypeptide and, optionally, 2A, Δ1D2A, GLuc and/or SGLuc.

68. The host cell of claim 62, wherein the vector or polynucleotide construct further comprises at least one polynucleotide sequence encoding a FMDV P1 precursor polypeptide from a FMDV O serotype, A serotype, C serotype, Asia 1 serotype, SAT1 serotype, SAT2 serotype or SAT3 serotype.

69. The host cell of claim 62, wherein the vector or polynucleotide construct further comprises at least one polynucleotide sequence encoding a FMDV P1 precursor polypeptide described by SEQ ID NOS: 102, 104, 106, 108, 110, 112, 114, 116 or 118, or encoding a FMDV P1 precursor polypeptide that has a polynucleotide sequence at least 95% identical to SEQ ID NOS: 101, 103, 105, 107, 109, 111, 113, 115, or 117.

70. The host cell of claim 62 that is a eukaryotic cell.

71. The host cell of claim 62 that is *Saccharomyces cerevisiae, Pichia pastoris*, or another yeast or fungus cell.

72. The host cell of claim 62 that is *Arabidopsis thaliana, Chlamydomonas reinhardtii, Glycine max, Nicotiana benthamiana, Nicotiana tabacum, Oryza sativa, Zea mays* or another plant cell.

73. The host cell of claim 62 that is *Spodoptera frugiperda, Drosophila melanogaster*, Sf9, Sf21, or another insect cell.

74. The host cell of claim 62 that is a vertebrate cell.

75. The host cell of claim 62 that is a HEK-293-T (human kidney embryo) cell, LF-BK (porcine cell), LF-BK αV/β6 cell, or another mammalian cell.

76. The host cell of claim 62 that is a cell from a mammal or other animal susceptible to FMDV infection.

77. The host cell of claim 62 that is a prokaryotic cell.

78. The host cell of claim 62 that is *Bacillus, Lactococcus, Streptomyces, Rhodococcus, Corynebacterium, Mycobacterium* or in another gram-positive prokaryote.

79. The host cell of claim 62 that is *Escherichia, Pseudomonas* or in another gram-negative prokaryote.

80. The host cell of claim 62, wherein said vector or polynucleotide construct is a minicircle vector, a replication deficient adenovirus vector, a vaccinia virus vector, or another viral vector that encodes and expresses the modified FMDV 3C protease, and optionally, an FMDV P1 precursor polypeptide or other polypeptide of interest besides the modified 3C protease.

81. The host cell of claim 62 comprising a vector or polynucleotide construct that encodes and expresses the modified FMDV 3C protease and a FMDV P1 precursor polypeptide, wherein said FMDV P1 precursor polypeptide is cleaved by the modified FMDV 3C protease expressed in the host cell.

82. The host cell of claim 62, further comprising at least one other vector or polynucleotide construct encoding an FMDV P1 precursor polypeptide or other polypeptide of interest.

83. A modified foot-and-mouth disease (FMDV) 3C protease comprising an amino acid substitution of L127P of a wild-type FMDV 3C protease.

84. The modified foot-and-mouth disease (FMDV) 3C protease of claim 83 comprising FMDV 3C protease residues H46, D84 and C163.

85. The modified foot-and-mouth disease (FMDV) 3C protease of claim 83 that is at least 95% identical to at least one wild-type protease from FMDV O serotype, A serotype, C serotype, Asia 1 serotype, SAT1 serotype, SAT2 serotype, or SAT3 serotype.

86. The modified foot-and-mouth disease (FMDV) 3C protease of claim 83 that is at least 95% identical to a wild-type FMDV 3C protease encoded by at least one wild-type polynucleotide sequence selected from the group consisting of SEQ ID NOS: 1, 3, 5, 7, 9, 11, 13, 15, 17, and 19.

87. The modified foot-and-mouth disease (FMDV) 3C protease of claim 83 that is at least 95% identical to at least one wild-type FMDV 3C protease amino acid sequence selected from the group consisting of SEQ ID NOS: 2, 4, 6, 8, 10, 12, 14, 16, 18, and 20.

88. The modified foot-and-mouth disease (FMDV) 3C protease of claim 83, further comprising one or more amino acid substitutions within residues or 26-35 of the wild-type FMDV 3C protease.

89. The modified foot-and-mouth disease (FMDV) 3C protease of claim 88, comprising an amino acid substitution at V28.

90. The modified foot-and-mouth disease (FMDV) 3C protease of claim 88, comprising the V28K substitution.

91. The modified foot-and-mouth disease (FMDV) 3C protease of claim 88, wherein the wild-type FMDV 3C protease sequence of residues 26-35 comprises the sequence corresponding to residues 26-35 of SEQ ID NO: 2 (KTVAICCATG) or the sequence corresponding to residues 26-35 of SEQ ID NO: 18 (KTVALCCATG).

92. The modified foot-and-mouth disease (FMDV) 3C protease of claim 83, wherein the wild-type sequence of residues 125-134 is GRLIFSG(D/E)AL (SEQ ID NO: 156).

93. The modified foot-and-mouth disease (FMDV) 3C protease of claim 83, selected from the group of amino acid sequences of SEQ ID NO: 22, 24, 26, 28, 30, 32, 34, 36, 38 and 40.

94. The modified foot-and-mouth disease (FMDV) 3C protease of claim 83, further comprising one or more substitutions within amino acid residues 138-150 of a wild-type FMDV 3C protease.

95. The modified foot-and-mouth disease (FMDV) 3C protease of claim 94, wherein the wild-type FMDV 3C protease sequence of residues 138-150 comprises the sequence corresponding to residues 138-150 of SEQ ID NO:

2 (DLVVCMDGDTMPG) or the sequence corresponding to residues 138-150 of SEQ ID NO: 18 (DLVVCMDGDT-MPG).

96. The modified foot-and-mouth disease (FMDV) 3C protease of claim 83, further comprising one or more substitutions within amino acid residues 141-142 of a wild-type FMDV 3C protease.

97. The modified foot-and-mouth disease (FMDV) 3C protease of claim 96, wherein the one or more substitutions comprise the V141T substitution.

98. The modified foot-and-mouth disease (FMDV) 3C protease of claim 96, wherein the one or more substitutions comprise the C142T substitution.

99. The modified foot-and-mouth disease (FMDV) 3C protease of claim 83 that does not contain glutamic acid (E) at position 126 (R126E), does not contain serine at position 133 (A133S), or both.

100. A composition comprising the modified FMDV 3C protease of claim 83 and a pharmaceutically acceptable excipient or adjuvant, or a buffer or solution suitable for proteolysis by said modified FMDV 3C protease.

\* \* \* \* \*